United States Patent 7,745,391 (HUMAN THROMBOSPONDIN POLYPEPTIDE) - sequence listing, part 299

SEQ ID NO: 1031199 - protein, 1268 aa, Homo sapiens
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 1031200 - protein, 1268 aa, Homo sapiens; identical to SEQ ID NO: 1031199

SEQ ID NO: 1031201 - protein, 460 aa, Homo sapiens
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRWVVPGPTTVPVLHRGLHLPGSSILMLIPPKSLEFSPHRNLIEPEQCTFCFTASRIDICLRKRQSQRWGGLEAPAARGLHTSSLHCPVPRDQDPNPCHMLLTTSPLIPPF

SEQ ID NO: 1031202 - protein, 212 aa, Homo sapiens
MVNLAFVKNDSYEKGPDSVVVHVYVKEICRDTSRVLFREQDFTLIFQTRWVGDDGASGGTVCLMLFLMSFLLILLCLCRDGNFLRLHPGCGPHTTFRWQVKLRWVVPGPTTVPVLHRGLHLPGSSILMLIPPKSPEFSPHRNLIEPEQCTFCFTASRIDICLRKRQSQRWGGLEAPAARGLHTSSLHCPVPRDQDPNPCHMLLTTSPLIPPF

SEQ ID NO: 1031203 - protein, 1224 aa, Homo sapiens
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEELLLDWRQSAEEVIVKLRVGVGPLQLEDVDAAFTDTDCVVRFAGGEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 1031204 - protein, 1250 aa, Homo sapiens
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 1031205 - protein, 1253 aa, Homo sapiens
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQVRHVGGFTEYWGTVHRLGPGWGI

SEQ ID NO: 1031206 - protein, 1140 aa, Homo sapiens
QKRAQGRGEVGAGAGPGAQAGPSAKRAVHLCRGPEGERVQDDPGPRGDAPPFVADPATQVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQGLGPGQAPEVAPTRTAPERFAPPVDRPAPTYSNMEEVD

SEQ ID NO: 1031207 - protein, 1268 aa, Homo sapiens; identical to SEQ ID NO: 1031199

SEQ ID NO: 1031208 - protein, 546 aa, Homo sapiens [sequence omitted]

SEQ ID NO: 1031209 - protein, 647 aa, Homo sapiens
MFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031210 - protein, 683 aa, Homo sapiens
GTPDLRRSARLGLPKCWDYRREQDFHSNKFQNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031211 - protein, 371 aa, Homo sapiens [sequence omitted]

SEQ ID NO: 1031212 - protein, 395 aa, Homo sapiens
MCLLVFSLYSAELMDPKELVPELHQSVITSGTFLSSGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031213 - protein, 677 aa, Homo sapiens
MPGFLVRILLLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031214 - protein, 677 aa, Homo sapiens; identical to SEQ ID NO: 1031213

SEQ ID NO: 1031215 - protein, 677 aa, Homo sapiens; identical to SEQ ID NO: 1031213

SEQ ID NO: 1031216 - protein, 405 aa, Homo sapiens
MPGFLVRILLLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKVGAWYELWWADLGRASFELTVVCGPLSGWSLLLKDGEGGSVDWVGSVPW

SEQ ID NO: 1031217 - protein, 136 aa, Homo sapiens
FVGAFFPPLLLACLHHGPPSSRLRCIWGCWFSVSLSPGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031218 - protein, 725 aa, Homo sapiens [sequence omitted]

SEQ ID NO: 1031219 - protein, 509 aa, Homo sapiens [sequence omitted]

SEQ ID NO: 1031220 - protein, 371 aa, Homo sapiens [sequence omitted]

SEQ ID NO: 1031221 - protein, 198 aa, Homo sapiens
MGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031222 - protein, 521 aa, Homo sapiens
QYVGCDGPARMLHDIIELVQQFGRPYISQGIITGPDEHTTIPGAAGNGAGGQADGGGPGHISNPVTVLPASALLPLAILEEVVTATCWKLLDVIGFLPEQLVYEASRDSINVRVPLMFWKWVTVGINQVVGGLDNCGVDSGILKDVTSLALSSELNAIPWMKQHCSYLLVSAPSAFIHLEMKTHLSYLICRVFFDPLVSQFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031223 - protein, 378 aa, Homo sapiens
MLAVMDLARMLHDIIELVQQFGRPYISQGIITGPDEHTTIPGAAGNGAGGQADGGGPGHISNPVTVLPASALLPLAILEEVVTATCWKLLDVIGFLPEQLVYEASRDSINVRVPLMFWKWVTVGINQVVGGLDNCGVDSGILKDVTSLALSSELNAIPWMKQHCSYLLVSAPSAFIHLEMKTHLSYLICRVFFDPLVSQFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHH

SEQ ID NO: 1031224 - protein, 677 aa, Homo sapiens; identical to SEQ ID NO: 1031213

SEQ ID NO: 1031225 - protein, 677 aa, Homo sapiens; identical to SEQ ID NO: 1031213

SEQ ID NO: 1031226 - protein, 518 aa, Homo sapiens
MPGFLVRILLLLLVLLLLGPTRGLRVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031227 - protein, 427 aa, Homo sapiens
MLAVMDLARMLHDIIELVQQFGRPYISQGIITGPDEHTTIPGAAGNGAGGQADGGGPGHISNPVTVLPASALLPLAILEEVVTATCWKLLDVIGFLPEQLVYEAFQFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 1031228 - protein, 414 aa, Homo sapiens
MPGFLVRILLLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPHTVRWPNTVRSPTRCGP

SEQ ID NO: 1031229 - protein, 840 aa, Homo sapiens
MGTPRAQHPPPPQLLFLILLSCPWIQGLPLKEEEILPEPGSETPTVASEALAELLHGALLRRGPEMGYLPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 1031230 - protein, 944 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSDRVLAQLRGPQPRQDIGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 1031231 - protein, 927 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKGCLVMELIMDNSDNTGEVTQTTDPSRQLEGGNLALAILLPLGLVIVLGSGVYIYYTKLQGKSLFGFSGSHSYSPITVESDFSNPLYEAGDTREYEVSI

SEQ ID NO: 1031232 - protein, 801 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRASLCASSAMRALSLSARSPSPVCPATPPSGPASPHSAKLPMRSSWTTENWK

SEQ ID NO: 1031233 - protein, 541 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRWGTVPAPESWPSCGDLSRAAAFSPLGPTSHCSFRHRPGPQIQAWARASYCTSKRSRGTTRAPSCHLRSGAGERHPTGT

SEQ ID NO: 1031234 - protein, 867 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEMLDGCPGLAPLATFWKTGSFGLGIDMRQLRPGLDCVRSGGSPLSPVIYDSDMDDVPERGLISDAQSLYVELLSETPANPLLLSLRFEAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 1031235 - protein, 143 aa, Homo sapiens
QRTRNTIGLVEAGGCQMRLKYEPCLNPGVPRMATRRCTSTCQKIMTCADPGEIANGHRTASDAGFPVGSHVQYRCLPGYSLEGAAMLTCYSRASLCASSAMRALSLSARSPSPVCPATPPSGPASPHSAKLPMRSSWTTENWK

SEQ ID NO: 1031236 - protein, 923 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 1031237 - protein, 769 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALSCL

SEQ ID NO: 1031238 - protein, 519 aa, Homo sapiens
MVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 1031239 - protein, 899 aa, Homo sapiens
MGTPRAQHPPPPQLLFLILLSCPWIQGLPLKEEEILPEPGSETPTVASEALAELLHGALLRRGPEMGYLPGSDPDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTTTRRASLCASSAMRALSL

SEQ ID NO: 1031240 - protein, 853 aa, Homo sapiens
MGTPRAQHPPPPQLLFLILLSCPWIQGLPLKEEEILPEPGSETPTVASEALAELLHGALLRRGPEMGYLPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 1031241 - protein, 809 aa, Homo sapiens [sequence omitted]

SEQ ID NO: 1031242 - protein, 92 aa, Homo sapiens
PPPTVSGPPRSFLVNIVVIPPGLQEFGTSGTVLPLGLVIVLGSGVYIYYTKLQGKSLFGFSGSHSYSPITVESDFSNPLYEAGDTREYEVSI

SEQ ID NO: 1031243 - protein, 87 aa, Homo sapiens
MNLEPPKAEFRSATRVAGGPVTPRKGPPKFKQRQTRQFKSKPPKKGVQGFGDDIPGMEGLGTDITVICPWEAFNHLELHELAQYGII

SEQ ID NO: 1031244 - protein, 226 aa, Homo sapiens
LALEGTQHCPCFCAWEDPQAPKGGGGSLFGFRSSRCKGPGVGGVRCEATAAGEGQAAEGFGDHEGGPFRDQAGSGKAVGRPKTADTVVASIWKMGSCRSLAVQGHTSLPVPAPSAGCPSLEPLTAPVPLLSIPWTLVVVPPLGAQQSHEGGTETPNQLMKSEIKAGAGTLRREAQHSQHSPLRPALHLFGDDIPGMEGLGTDITVICPWEAFNHLELHELAQYGII

SEQ ID NO: 1031245 - protein, 118 aa, Homo sapiens
AETLSLLTTATDRSRRESRSQGCRGVSVSLTMNLEPPKAEFRSATRVAGGPVTPRKGPPKFKQRQTRQFKSKPPKKGVQGFGDDIPGMEGLGTDITVICPWEAFNHLELHELAQYGII

SEQ ID NO: 1031246 - protein, 87 aa, Homo sapiens; identical to SEQ ID NO: 1031243

SEQ ID NO: 1031247 - protein, 223 aa, Homo sapiens
RSDALGTRPVGAWRPIEAGVHGRPGLSPGSGPGDCRRIRAEGWGWRGRSLPLARSSGGRRGRGPRGEETQPRGWHARPGPGPRSTGAMLFSLRELVQWLGFATFEIFVHLLALLVFSVLLALRVDGLVPGLSWWNVFVPFFAADGLSTYFTTIVSVRLFQDGEKRLAVLRLFWVLTVLSLKFVFEMLLCQKLAEQTRELWFGLITSPLFILLQLLMIRACRVN

SEQ ID NO: 1031248 - protein, 223 aa, Homo sapiens; identical to SEQ ID NO: 1031247

SEQ ID NO: 1031249 - protein, 136 aa, Homo sapiens
MLFSLRELVQWLGFATFEIFVHLLALLVFSVLLALRVDGLVPGLSWWNVFVPFFAADGLSTYFTTIVSVRLFQDGEKRLAVLRLFWVLTVLSLKFVFEMLLCQKLAEQTRELWFGLITSPLFILLQLLMIRACRVN

SEQ ID NO: 1031250 - protein, 69 aa, Homo sapiens
TDIQPIVAHHAVLRLGDLDVTQGAVITGAVVAAVMWRRKSSDRKGGSYSQAASSDSAQGSDVSLTACKV

SEQ ID NO: 1031251 - protein, 113 aa, Homo sapiens
GSWETRPAGDGTFQKWVAVVVPSGQEQRYTCHVQHEGLPKPLTLRWEPSSQPTIPIVGIIAGLVLFGAVITGAVVAAVMWRRKSSDRKGGSYSQAASSDSAQGSDVSLTACKV

SEQ ID NO: 1031252 - protein, 364 aa, Homo sapiens
AGRLRASRPVRGPRRRSRRSRRSRSRPAARPEPRVPRPGSRLPETRPACPAQPPEKMRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 1031253 - protein, 364 aa, Homo sapiens; identical to SEQ ID NO: 1031252

SEQ ID NO: 1031254 - protein, 364 aa, Homo sapiens; identical to SEQ ID NO: 1031252

SEQ ID NO: 1031255 - protein, 305 aa, Homo sapiens
AGRLRASRPVRGPRRRSRRSRRSRSRPAARPEPRVPRPGSRLPETRPACPAQPPEKMRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGILRPVRSTRSVPRAPVLYAPRQPRANKK

SEQ ID NO: 1031256 - protein, 300 aa, Homo sapiens
MRDNTNVYRKQAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 1031257 - protein, 874 aa, Homo sapiens
MLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031258 - protein, 213 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDVSASTQLSLRGGSCNKVVGGPKRAGPPVSVGCLCGDRRYLLPTLALGEPGLIGLFPPISQPTLRRMCYLTIKEMSCIAEDVIIVTSRQSMGVWGGSF

SEQ ID NO: 1031259 - protein, 891 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSERTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031260 - protein, 874 aa, Homo sapiens; identical to SEQ ID NO: 1031257

SEQ ID NO: 1031261 - protein, 558 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLRSSARVPRSWAPLQVLA

SEQ ID NO: 1031262 - protein, 797 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031263 - protein, 909 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031264 - protein, 909 aa, Homo sapiens; identical to SEQ ID NO: 1031263

SEQ ID NO: 1031265 - protein, 482 aa, Homo sapiens
GRLLLLNSRPRRLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031266 - protein, 843 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEGKILGMPSLA

SEQ ID NO: 1031267 - protein, 359 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPSSSPRLSPWPSPSQRRSMSSAAPNTPSPTTWFFSLTAQTHSMTRPWRMSQCRWSPLRPMRCSVTCLPGACPTTSPGPATHWWHCPKKTPQLWPAHSAA

SEQ ID NO: 1031268 - protein, 559 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEPALQPARDLLHTGGTAQRRPHSCGLHIQLHDEVHCQGL

SEQ ID NO: 1031269 - protein, 172 aa, Homo sapiens
SSALLDPDDLPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031270 - protein, 909 aa, Homo sapiens; identical to SEQ ID NO: 1031263

SEQ ID NO: 1031271 - protein, 933 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVSTVEDGRTFLELEMTPRQELLYDQLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031272 - protein, 913 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVVGGGE

SEQ ID NO: 1031273 - protein, 559 aa, Homo sapiens; identical to SEQ ID NO: 1031268

SEQ ID NO: 1031274 - protein, 443 aa, Homo sapiens
MRSQVEAPTHSSTLRRVRYSRRPVYLMKLPSTLGNVPTSSPRFFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 1031275 - protein, 668 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPSAVLG

SEQ ID NO: 1031276 - protein, 550 aa, Homo sapiens
SGGPGSGPCRTTVAPLLRAAPVEHCVAALRPTDSTMLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKR

SEQ ID NO: 1031277 - protein, 874 aa, Homo sapiens; identical to SEQ ID NO: 1031257

SEQ ID NO: 1031278 - protein, 955 aa, Homo sapiens
SGARGAGFSAAAARAAAMLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 1031279 - protein, 876 aa, Homo sapiens
MTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 1031280 - protein, 664 aa, Homo sapiens
MDLISKNTYGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 1031281 - protein, 955 aa, Homo sapiens; identical to SEQ ID NO: 1031278

SEQ ID NO: 1031282 - protein, 860 aa, Homo sapiens
SGARGAGFSAAAARAAAMLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSSLSCQISVALTATVRGETAWLEATPQSQAWAVLGATAPCTGASSAGWRAWLSLPPCRLGAGLSVCSSFLKKEGSYVYC

SEQ ID NO: 1031283 - protein, 955 aa, Homo sapiens; identical to SEQ ID NO: 1031278

SEQ ID NO: 1031284 - protein, 955 aa, Homo sapiens; identical to SEQ ID NO: 1031278

SEQ ID NO: 1031285 - protein, 585 aa, Homo sapiens
SGARGAGFSAAAARAAAMLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRY

SEQ ID NO: 1031286 - protein, 482 aa, Homo sapiens
SGARGAGFSAAAARAAAMLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDELHLDPASQQKVCV

SEQ ID NO: 1031287 - protein, 708 aa, Homo sapiens
MIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 1031288 - protein, 955 aa, Homo sapiens; identical to SEQ ID NO: 1031278

SEQ ID NO: 1031289 - protein, 636 aa, Homo sapiens
SGARGAGFSAAAARAAAMLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVHLTKMNYLPPCLFLGWGVASDGGRVPVGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 1031290 - protein, 488 aa, Homo sapiens
MVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 1031291 - protein, 955 aa, Homo sapiens; identical to SEQ ID NO: 1031278

SEQ ID NO: 1031292 - protein, 597 aa, Homo sapiens
SGARGAGFSAAAARAAAMLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKVSCCRSFWKWCLAVPILCCWVFQPVALCVVSGTMSFGAPRLSSSQTIHQ

SEQ ID NO: 1031293 - protein, 635 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPTGPTSSESGSPRCQVRLPVRCRGCCSEASLSVGPPQSPWGWPELRALRPGHRACLVGDLPKQVKLKKPFKVEDPGHQARPLHRYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031294 - protein, 610 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPPNVVLGVTNPFFIKTLQHWPHILRVGEPKMSGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031295 - protein, 656 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQIRRSWGSCPVKLVGRATLGQLQSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPTGPTSSESGSPRCQVRLPVRCRGCCSEASLSVGPPQSPWGWPELRALRPGHRACLVGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031296 - protein, 659 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKALGSSPTGRHPGSSVLGFLLSNNSGVQVRRSWGSCPVKLVGRATLGQLQSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPPNVVLGVTNPFFIKTLQHWPHILRVGEPKMSGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031297 - protein, 713 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKALGSSPTGRHPGSSVLGFLLSNNSGVQVRRSWGSCPVKLVGRATLGQLPGEGFGGPRGLLSGEGEAWHWASTGPVALQSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPTGPTSSESGSPRCQVRLPVRCRGCCSEASLSVGPPQSPWGWPELRALRPGHRACLVGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031298 - protein, 661 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPPNVVLGVTNPFFIKTLQHWPHILRVGEPKMSGQAPGEVQGVLLRSLVECGAASEPVGMARAAGTEAWPPGVSRGDLPKQVKLNTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRCLPALSQRHQPGTELRLPWPWLPLQVRAQGHQLPVKEATLQRAQLYIETVIGSLPKDLQAVLCPP

SEQ ID NO: 1031299 - protein, 483 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPPNVVLGVTNPFFIKTLQHWPHILRVGEPKMSGDLPKQVKLKKPSRLKTLDTKPGLYTAYTAHLHRDKALLKRLLKGVQKKRPSDVQSALLRRHLLELTQSFIIPLEHYMASLIAPAEVRLGAEVRLGTDVRQ

SEQ ID NO: 1031300 - protein, 160 aa, Homo sapiens
RDCSEERPGRAPPPPAFPRQPAAAAMDALLGTGPRRARGCLGAAGPTSSGRAARTPAAPWARFSAWLECVCVVTFDLELGQALEVSGRERGRGRVGRAAPLGASPASLGALGRPALSLAFGRRLLEGPLLRAPEALPRPRREGELLGVGSCLHIGMEHFA

SEQ ID NO: 1031301 - protein, 579 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031302 - protein, 652 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPPNVVLGVTNPFFIKTLQHWPHILRVGEPKMSGQAPGEVQGVLLRSLVECGAASEPVGMARAAGTEAWPPGVSRGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031303 - protein, 621 aa, Homo sapiens
RDCSEELARTRAAPARVSPATRGRRHGRAVGHRASPGSRLPGRGWTHVFRSRGADPGGALGALLRLAGVCVRGHLRPGAGPGAGAGVSERLPAHRQGGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPTGPTSSESGSPRCQVRLPVRCRGCCSEASLSVGPPQSPWGWPELRALRPGHRACLVGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031304 - protein, 403 aa, Homo sapiens
MGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPTGPTSSESGSPRCQVRLPVRCRGCCSEASLSVGPPQSPWGWPELRALRPGHRACLVGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 1031305 - protein, 439 aa, Homo sapiens
RDCSEERPGRAPPPPAFPRQPAAAAMDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPGDLPKQVKLKKPSRLKTLDTKPGLYTAYTAHLHRDKALLKRLLKGVQKKRPSDVHSCTSRRSSAPCPKTCRLSCALPRTKPRATVPGP

SEQ ID NO: 1031306 - protein, 158 aa, Homo sapiens
MKPGDIRHAPNNLASDVLGILVALGFDDFRGEFCNQQPPEILVAFPFPKPALISHLERGEAPWGPDPWDTEILRGISQGGESWIKNEGLVIKQEASEETELHRMPVEDFSGTFLSTLILKGGPEADFQSNPNLILRGGMKLYECKNVGTLRYTKVFGR

SEQ ID NO: 1031307 - protein, 173 aa, Homo sapiens
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVEDFSGTFLSTLILKGGPEADFQSNPNLILRGGMKLYECKNVGTPGIQRYSADDHKGRPL

SEQ ID NO: 1031308 - protein, 135 aa, Homo sapiens
MRTSSWMVPEWVWDTEGPAGGHWSPLGREESLSYHGVALALQVGGQLGVVVHALVGGIGQVHLGEGPRTDLLGGEQVAIVLALTHLLREGSLIQLLPAAALHGGQCMEGGVVVQFHQSWGAQLRPDLCQRAGARW

SEQ ID NO: 1031309 - protein, 80 aa, Homo sapiens
LDYIVNEPPPKLPSGVFSLEFQDFVNKCLIKNPAERADLKQLMVHAFIKRSDAEEVDFAGWLCSTIGLNQPSTPTHAAGV

SEQ ID NO: 1031310 - protein, 286 aa, Homo sapiens
MRRRPGASPVPGVCVSPRAVGKAGAVRRQEAKGTQDQTRGANSAGGPCTDHARSRTKARPVAVATARGVDAGAASRELSVQAHRLLGLRRIACACALLTRGRFCAPQWLPASIGEAELSVFYRTGSPDAAGGSSRPPSTHPPPLLHQDFISVTQSFGESYGNSKNCRRLLCCRVRTAPGGPRPGVAAPAALPACGSERGLGGQTRLPPTPPSPPLPRKKGQICFPGRGSRGRHACSGLSGPNSAGRWWWEEGLEPQQVVWASFDFRQGPGPGPSPSWSGSLWTCCS

SEQ ID NO: 1031311 - protein, 269 aa, Homo sapiens
MRRRPGASPVPGVCVSPRAVGKAGAVRRQEAKGTQDQTRGANSAGGPCTDHARSRTKARPVAVATARGVDAGAASRELSVQAHRLRGLRRIACACALLTRGRFCAPQWLPASIGEAELSVFYRTGSPDAAGGSSRPPSTHPPPLLHQDFISVTQSFGESYGNSKNCRRAAPAALPACGSERGLGGQTRLPPTPPSPPLPRKKGQICFPGRGSRGRHACSGLSGPNSAGRWWWEEGLEPQQVVWASFDFRQGPGPGPSPSWSGSLWTCCS

SEQ ID NO: 1031312 - protein, 132 aa, Homo sapiens
RWLERRDFLKVRDWPERPPLTVRGCRIPSAGDAAAEGGRGRPGGSRRGPWLGKYQDGSWQRRRARPRGRCPGARTYREEPRPLHPHVGTEPGGSRAGRRRRTPRSSPPSALTESPPRNLWRGRLALGEEAAR

SEQ ID NO: 1031313 - protein, 132 aa, Homo sapiens; identical to SEQ ID NO: 1031312

SEQ ID NO: 1031314 - protein, 120 aa, Homo sapiens
GTGPELSGSGSRPAVRCLLRSGGLSVMAWGGMPDRGPWLGKYQDGSWQRRRARPRGRCPGARTYREEPRPLHPHVGTEPGGSRAGRRRRTPRSSPPSALTESPPRNLWRGRLALGEEAAR

SEQ ID NO: 1031315 - protein, 132 aa, Homo sapiens; identical to SEQ ID NO: 1031312

SEQ ID NO: 1031316 - protein, 176 aa, Homo sapiens
EFGTSLGGHGRRPDPVKRAAGYPARRHRGAGTRRAATHPLAARVLRFAQGARRFSSPDCCQRLPGGGSFLQRHHPGAQAPDGRRKFGTDHVEVGSQAGADGTRPPKASLPPELQPPTNCCMSGCPNCVWVEYADRLLQHFQDGGERALAALEEHVADENLKAFLRMEIRLHTRCGG

SEQ ID NO: 1031317 - protein, 132 aa, Homo sapiens; identical to SEQ ID NO: 1031312

SEQ ID NO: 1031318 - protein, 136 aa, Homo sapiens
AQVAAGPWLGARRFSSPDCCQRLPGGGSFLQRHHPGAQAPDGRRKFGTDHVEVGSQAGADGTRPPKASLPPELQPPTNCCMSGCPNCVWVEYADRLLQHFQDGGERALAALEEHVADENLKAFLRMEIRLHTRCGG

SEQ ID NO: 1031319 - protein, 71 aa, Homo sapiens
MSGCPNCVWVEYADRLLQHFQDGGERALAALEEHVADENLKAFLRMEIRLHTRCGVTSWWIPPRRVRRPGS

SEQ ID NO: 1031320 - protein, 132 aa, Homo sapiens; identical to SEQ ID NO: 1031312

SEQ ID NO: 1031321 - protein, 173 aa, Homo sapiens
RWLERRDFLKVRDWPERPPLTVRGCRIPSAGDAAAEGGRGRPGGSRRGPWLGKYQDGSWQRRRARPRGRCPGARTYREEPRPLHPHVGTEPGGSRAGRRRRTPRSSPPSALTESPPRNLWRGRLALGEEAARGLAGSPARTAARGFLEVAAFFKGTIPERKPLMGAENSGQTT

SEQ ID NO: 1031322 - protein, 132 aa, Homo sapiens; identical to SEQ ID NO: 1031312

SEQ ID NO: 1031323 - protein, 605 aa, Homo sapiens
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKKQDKKGSFQIVSATHKKIPTIERSHKNTELSQNFSPKSVLIRQQILPREKTPPKCEIQGNSLKQNSQLLNQPKITADKRYKCSLCEKTFINTSSLRKHEKNHSGEKLFKCKECSKAFSQSSALIQHQITHTGEKPYICKECGKAFTLSTSLYKHLRTHTVEKSYRCKECGKSFSRRSGLFIHQKIHAEENPCKYNPGRKASSCSTSLSGCQRIHSRKKSYLCNECGNTFKSSSSLRYHQRIHTGEKPFKCSECGRAFSQSASLIQHERIHTGEKPYRCNECGKGFTSISRLNRHRIIHTGEKYYNCNECGKALSSHSTLIIHERIHTGEKPCKCKVCGKAFRQSSALIQHQRMHTGERPYKCNECGKTFRCNSSLSNHQRIHTGEKPYRCEECGISFGQSSALIQHRRIHTGEKPFKCNTCGKTFRQSSSRIAHQRIHTGEKPYECNTCGKLFNHRSSLTNHYKIHIEEDP

SEQ ID NO: 1031324 - protein, 132 aa, Homo sapiens
MAAGQREARPQVSLTFEDVAVLFTRDEWRKLAPSQRNLYRDVMLENYRNLVSLGLPFTKPKVISLLQQGEDPWEVEKDGSGVSSLGCKSTPKMTKSTQTQDSFQEQITDKIDKGMNPGTSYQKDPAYMNEDN

SEQ ID NO: 1031325 - protein, 712 aa, Homo sapiens
ELSGVGEPWPWWAQRVAAATAVQRPLRKPQACGAWACRAAQRCSGPRAPGSSRIPVRARGVLLSGSRGFRAADSRAGKQKGFFLAPFFWEICLLETAPSSRESQKEDMAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKKQDKKGSFQIVSATHKKIPTIERSHKNTELSQNFSPKSVLIRQQILPREKTPPKCEIQGNSLKQNSQLLNQPKITADKRYKCSLCEKTFINTSSLRKHEKNHSGEKLFKCKECSKAFSQSSALIQHQITHTGEKPYICKECGKAFTLSTSLYKHLRTHTVEKSYRCKECGKSFSRRSGLFIHQKIHAEENPCKYNPGRKASSCSTSLSGCQRIHSRKKSYLCNECGNTFKSSSSLRYHQRIHTGEKPFKCSECGRAFSQSASLIQHERIHTGEKPYRCNECGKGFTSISRLNRHRIIHTGEKFYNCNECGKALSSHSTLIIHERIHTGEKPCKCKVCGKAFRQSSALIQHQRMHTGERPYKCNECGKTFRCNSSLSNHQRIHTGEKPYRCEECGISFGQSSALIQHRRIHTGEKPFKCNTCGKTFRQSSSRIAHQRIHTGEKPYECNTCGKLFNHRSSLTNHYKIHIEEDP

SEQ ID NO: 1031326 - protein, 605 aa, Homo sapiens; identical to SEQ ID NO: 1031323

SEQ ID NO: 1031327 - protein, 85 aa, Homo sapiens
MGTAKANHWAWLLVLRFLFGCSVLQILLPSFSFMSRVQRKDAEQESQTKAEIQDMKQELSAVNMMDKFARSAKLERKINKMMNKL

SEQ ID NO: 1031328 - protein, 79 aa, Homo sapiens
NRNTCFLYYMANAGYAAVVGVKLCPKVEKWVQRKDAEQESQTKAEIQDMKQELSAVNMMDKFARSAKLERKINKMMNKL

SEQ ID NO: 1031329 - protein, 339 aa, Homo sapiens
MTPLMSPSLAAGPAGVLTVELAGVRPTVAGAGVGAGVPLTLTRRRGVCVPWLEISDLDRQIEQLRRCELIKESEVKALCAKAMRDLGRGEQLCRGWTRQSQCAADIHGQFYDLKELFRVGGDVPENNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIERKQEVPHDGPMCDLLWSDPEDTTGWGVSPRRKPATYLAIDVVAQFTAHDIDLSWRASTGDGTGHSGTSRERGLCNRAQDCTGGTAGTGRETLQNITEGAQKGTQNRH

SEQ ID NO: 1031330 - protein, 140 aa, Homo sapiens
PAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 1031331 - protein, 204 aa, Homo sapiens
WGTRGHIVSGSKHRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 1031332 - protein, 204 aa, Homo sapiens; identical to SEQ ID NO: 1031331

SEQ ID NO: 1031333 - protein, 94 aa, Homo sapiens
LHLGEGEVAKDVPRKGWKKPTMAHVPLPLGLGILGEGTPMSHLESSYHFLCPPFQAFPLTSTPLSSPVYCLRLTTKHLYAALSYNLHVLDFQNP

SEQ ID NO: 1031334 - protein, 204 aa, Homo sapiens; identical to SEQ ID NO: 1031331

SEQ ID NO: 1031335 - protein, 210 aa, Homo sapiens
WGTRGHIVSGSKHRTAKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRPCLARARIWPGEAHPIPLIRAMTAYRVR

SEQ ID NO: 1031336 - protein, 197 aa, Homo sapiens
RIPMDQADGKVWPLASGRLGQCLHTIQTEDRVWSIAISPLLSSFVTGTACCGHFSPLRIWDLNSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 1031337 - protein, 185 aa, Homo sapiens
AGGWGEQAGAPQAGGCDHGGVLAPGWGPARPGTPGTARYSCFLSDFSPQTQSGQLMTHLGSDFPPGAGVLDVMYESPFTLLSCGYDTYVRYWDLRTSVRKCVMEWEEPHDSTLYCLQTDGNHLLATGSSYYGVVRLWDRRQRACLHAFPLTSTPLSSPVYCLRLTTKHLYAALSYNLHVLDFQNP

SEQ ID NO: 1031338 - protein, 204 aa, Homo sapiens; identical to SEQ ID NO: 1031331

SEQ ID NO: 1031339 - protein, 753 aa, Homo sapiens [sequence omitted]

SEQ ID NO: 1031340 - protein, 910 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPRGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 1031341 - protein, 1004 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLGLSSPCAPTHWPHGRVPEACLSSAGASAPTGLVSCLLGCPSTSLAFETPSVASSEFSEPSCGGESETAALGGGSRSVPAPWAGLVPSLSQHLPAAGLRSLRLLVLHSNLLASVPADLARLPLLTRLDLRDNQLRDLPPELLDAPFVRLQGNPLGEASPDAPSSPVAALIPEMPRLFLTSDLDSFPVTPRGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 1031342 - protein, 1024 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGSIWDLGPWLRGPHPPPPFPGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLGLSSPCAPTHWPHGRVPEACLSSAGASAPTGLVSCLLGCPSTSLAFETPSVASSEFSEPSCGGESETAALGGGSRSVPAPWAGLVPSLSQHLPAAGLRSLRLLVLHSNLLASVPADLARLPLLTRLDLRDNQLRDLPPELLDAPFVRLQGNPLGEASPDAPSSPVAALIPEMPRLFLTSDLDSFPVTPRGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 1031343 - protein, 947 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLGLSSPCAPTHWPHGRVPEACLSSAGASAPTGLVSCLLGCPSTSLAFETPSVASSEFSEPSCGGESETAALGGGSRSVPAPWAGLVPSLSQHLPAAGLRSLRLLVLHSNLLASVPADLARLPLLTRLDLRDNQLRDLPPELLDAPFVRLQGNPLGEASPDAPSSPVAALIPEMPRLFLTSDLDSFPVTPRGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPPEPAQA

SEQ ID NO: 1031344 - protein, 580 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLGLSSPCAPTHWPHGRVPEACLSSAGASAPTGLVSCLLGCPSTSLAFETPSVASSEFSEPSCGGESETAALGGGSRSVPAPWAGLVPSLSQHLPAAGLRSLRLLVLHSNLLASVPADLARLPLLTRLDLRDNQLRDLPPELLDAPFVRLQGNPLGEASPDAPSSPVAALIPEMPRLFLTSDLDSFPVTPRGCSVTLACGVRLQFPAGATATPITIRYRLLLPEPGLVPLGPHDALLSHVLELQPHGVAFQQDVGLWLLFTPPQARRCREVVVRTRNDNSWGDLETYLEGRGPKGLVMAVPFSGLGSAGKLAGPGDAAPGREHSRAEDTSTRAGTKAEKGPGVAPE

SEQ ID NO: 1031345 - protein, 418 aa, Homo sapiens [sequence omitted]

SEQ ID NO: 1031346 - protein, 986 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLGLSSPCAPTHWPHGRVPEACLSSAGASAPTGLVSCLLGCPSTSLAFETPSVASSEFSEPSCGGESETAALGGGSRSVPAPWAGLVPSLSQHLPAAGLRSLRLLVLHSNLLASVPADLARLPLLTRLDLRDNQLRDLPPELLDAPFVRLQGNPLGEASPDAPSSPVAALIPEMPRLFLTSDLDSFPVTPRGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPVGLRDSRGAGQDRGPGVTRVTWWSWGWSPGLNATFSFQQRLRGSEGPRRGAGLSLAPLNLGDAETGFLTQSNLLSVAGRLGLDWPAVALHLGVSYREVQRIRHEFRDDLDEQIRHMLFSWAERQAGQPPEPAQA

SEQ ID NO: 1031347 - protein, 107 aa, Homo sapiens
QSVVGGPGQVDRTLCRPSSACRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 1031348 - protein, 893 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPRGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 1031349 - protein, 228 aa, Homo sapiens
MGYKDNDGEEEEREGGAAGPRGSRLPPITGGASELAKRKVKKKKRKKKTKGSGKGDDKHQSQSLKSQPLSSSFHDILSPCKERGPKPEHRQSKVEKKHLPSDSSTVSLPDFAEIENLANRINESLRWDGILADPEAEKERIRIYKLNRRKRYRCLALKGFHPDPEALKGFHTDPNAEEAPENLPYLSDKDGSSSHRQPTSKAECPNLCFEGNLTPKLLHSDLAPTLLE

SEQ ID NO: 1031350 - protein, 321 aa, Homo sapiens
MGYKDNDGEEEEREGGAAGPRGSRLPPITGGASELAKRKVKKKKRKKKTKGSGKGDDKHQSQSLKSQPLSSSFHDILSPCKERGPKPEHRQSKVEKKHLPSDSSTVSLPDFAEIENLANRINESLRWDGILADPEAEKERIRIYKLNRRGTGAWPSRLPPRPRGPQGFHPDPDALKASTPPRGPQGFHPDPKALKGFHPDPKALKGFHTDPEALKGFHPDPKALKGFHPDPEALKGFHPEPRKRYRCLALKGFHPDPEALKGFHTDPNAEEAPENLPYLSDKDGSSSHRQPTSKAECPNLCFEGNLTPKLLHSDLAPTLLE

SEQ ID NO: 1031351 - protein, 228 aa, Homo sapiens; identical to SEQ ID NO: 1031349

SEQ ID NO: 1031352 - protein, 150 aa, Homo sapiens
MARWCQNYNCSGLRRDGSDKHQSQSLKSQPLSSSFHDILSPCKERGPKPEHRQSKVEKKHLPSDSSTVSLPDFAEIENLANRINESLRWDGILADPEAEKERIRIYKLNRRDGSSSHRQPTSKAECPNLCFEGNLTPKLLHSDLAPTLLE

SEQ ID NO: 1031353 - protein, 228 aa, Homo sapiens; identical to SEQ ID NO: 1031349

SEQ ID NO: 1031354 - protein, 188 aa, Homo sapiens
MGYKDNDGEEEEREGGAAGPRGSRLPPITGGASELAKRKVKKKKRKKKTKGSGKGDDKHQSQSLKSQPLSSSFHDILSPCKERGPKPEHRQSKVEKKHLPSDSSTVSLPDFAEIENLANRINESLRWDGILADPEAEKERIRIYKLNRRDGSSSHRQPTSKAECPNLCFEGNLTPKLLHSDLAPTLLE

SEQ ID NO: 1031355 - protein, 249 aa, Homo sapiens
QFAGSLSAAPRFSETATMGFDLKSPAGLQVLNDLAHTPLHPVCALTKQLWQYLNALSSPPPAHSHPLRWYNHIKSYEKEKRQPPGVKKALGKYGPADVEDTTGSGATDSKDDDDIDLFGSDDEEESEEAKRLREEPLAQYESKKAKKPALVAKSSILLDVKPWDDETDMAKLEECVRSIQADGLVWGSFKLGPVGYGIKKLQIQCVVEDDKVGTDMLEEQITAFERLCAVHDVAAFNNTKSILCILLAS

SEQ ID NO: 1031356 - protein, 314 aa, Homo sapiens
AAVVLVVRAQRLTGRIAFAAARPQTFVPGPSSPPPPPPPRPAELAPSPPADMSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALIRLHKVDPLRAHQPQKYYCKDHPSSFQNEQPDYNTHGGASPDSGVYMPQCPSAIVCNHGQGDKKRAKENATTHRQERASSSNSPKTRDRNRPQTDTTNRRSTRDSRRRQNDNN

SEQ ID NO: 1031357 - protein, 63 aa, Homo sapiens
AAVVLVVRAQRLTGRIAFAAARPQTFVPGPSSPPPPHAANCPSPPQMSSPAHASAPPLLPAPP

SEQ ID NO: 1031358 - protein, 519 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 1031359 - protein, 510 aa, Homo sapiens
WLSEAAGLKFRATAADAERHRFFLKEKRCAREPLVHMASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPSSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 1031360 - protein, 241 aa, Homo sapiens [sequence omitted]

SEQ ID NO: 1031361 - protein, 315 aa, Homo sapiens
MLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 1031362 - protein, 192 aa, Homo sapiens
MPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 1031363 - protein, 512 aa, Homo sapiens
MCECPGLRVAGHLSPDLPLLLLAGTLLQAVSSVQVGRGWQGVRARGKRDHRVTQKHPPFKGSPGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 1031364 - protein, 398 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSGKGGPDGLHDLDNN

SEQ ID NO: 1031365 - protein, 120 aa, Homo sapiens
MWPSLEALCSLFAARSTGSQAQSAPTPAWDEDTAQIGPKRIRKAAKRELMPCDFPGCGRIFSNRQYLNHHKKYQHIHQKSFSCPEPACGKSFNFKKHLKEHMKLHSGKGGPDGLHDLDNN

SEQ ID NO: 1031366 - protein, 140 aa, Homo sapiens
MKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 1031367 - protein, 140 aa, Homo sapiens; identical to SEQ ID NO: 1031366

SEQ ID NO: 1031368 - protein, 519 aa, Homo sapiens; identical to SEQ ID NO: 1031358

SEQ ID NO: 1031369 - protein, 190 aa, Homo sapiens
MWPSLEALCSLFAARSTGSQAQSAPTPAWDEDTAQIGPKRILEMLAKMMMLDCLCCIFPLVSCCNSSQSRARYFLNVTQQENVPMQTSSHLKKAFFFLAPRSASPCWGKFFFKLFNEQQPLRWEATFDMLCNKVTPPGDIQFLVKVSLQPRGPFPRNLAKQTPFVNSNKDSNSNNLGRKKTPPCKVVEDY

SEQ ID NO: 1031370 - protein, 116 aa, Homo sapiens
MGAEDVPSTLQPLVHMASSPAVDVSCRRREKRRQLDARRSKCRIRLGGHMEQWCLLKERLGFSLHSQLAKFLLDRLGAGRRAWGRVPRQQPLASSPGPVLLLFSTLRFLTLPGRPV

SEQ ID NO: 1031371 - protein, 197 aa, Homo sapiens
MAGGESQREEGPQGDPETPSFQREPPASSPSRVTQWSPRALSQHLCPWASGIQRGVQALCISSGSNPASSAMSSPPALALGSQTPGTEKEQQGEGLLEKCQMLGPQELRRQSAGWGQDWAVGELDYFSLPKGQNKQYFMQAKTTQNWQHKHQHRPPPGTTHHHDPPRHSRQTETRNDTDNSYSRETNTESTTTNESI

SEQ ID NO: 1031372 - protein, 350 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAQASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 1031373 - protein, 315 aa, Homo sapiens; identical to SEQ ID NO: 1031361

SEQ ID NO: 1031374 - protein, 241 aa, Homo sapiens [sequence omitted]

SEQ ID NO: 1031375 - protein, 192 aa, Homo sapiens; identical to SEQ ID NO: 1031362

SEQ ID NO: 1031376 - protein, 241 aa, Homo sapiens [sequence omitted]

SEQ ID NO: 1031377 - protein, 241 aa, Homo sapiens [sequence omitted]

SEQ ID NO: 1031378 - protein, 523 aa, Homo sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLWDPARGPGPLHLLRLQPCFLSNELSSSFGFGKPDSRD

SEQ ID NO: 1031379 - protein, 140 aa, Homo sapiens; identical to SEQ ID NO: 1031366

SEQ ID NO: 1031380 - protein, 139 aa, Homo sapiens
WLSEAAGLKFRATAADAERHRFFLKEKRCAREVGPCLPAAPGLLARPGRRRRRRSGGEGAWGRTASGAHGFLPGGGRVLQAAGEAAAAGRAPQQVPHPPGRPHGAVVPPQGAAGLLPALAARQVPVGPVHFFRLCPLCR

SEQ ID NO: 1031381 - protein, 315 aa, Homo sapiens; identical to SEQ ID NO: 1031361

SEQ ID NO: 1031382 - protein, 219 aa, Homo sapiens
MEAARDYAGALIRPLTFMGSQTKRVLFTPLMHPARPFRVSNHDRSSRRGVMASSLQELISKTLDALVIATGLVTLVLEEDGTVVDTEEFFQTLGDNTHFMILEKGQKWMPGSQHVPTCSPPKRSGIARVTFDLYRLNPKDFIGCLNVKATMYEMYSVSYDIRCTGLKGLLRSLLRFLSYSAQVTGQFLIYLGTYMLRVLDDKEERPSLRSQAKGRFTCG

SEQ ID NO: 1031383 - protein, 322 aa, Homo sapiens
GARGQSESRPAPPHPLAAGHRYQVWLLRGARASANQVTAGEWLHASLAAAAVAGAEEGPVPGTPSKASAMRGDRASGGPGNHNGSWAREGPRLGPSWKRGLWSPRGGPNRPAEPSRPLTFMGSQTKRVLFTPLMHPARPFRVSNHDRSSRRGVMASSLQELISKTLDALVIATGLVTLVLEEDGTVVDTEEFFQTLGDNTHFMILEKGQKWMPGSQHVPTCSPPKRSGIARVTFDLYRLNPKDFIGCLNVKATMYEMYSVSYDIRCTGLKGLLRSLLRFLSYSAQVTGQFLIYLGTYMLRVLDDKEERPSLRSQAKGRFTCG

SEQ ID NO: 1031384 - protein, 242 aa, Homo sapiens
GARGQSESRPAPPHPLAAGHRYQVWLLRGARASANQVTAGEWLHASLAAAAVAGAEEGPVPGTPSKASAMRGDRASGGPGNHNGSWAREGPRLGPSWKRGLWSPRGGPNRPAEPSRPLTFMGSQTKRVLFTPLMHPARPFRVSNHDRSSRRGVMASSLQELISKTLDALVIATGLVTLVLEEDGTVVDTEEFFQTLGDNTHFMILEKGQKWMPESAAVPVLLRPGDGTVSHLSGHIHAPGAG

SEQ ID NO: 1031385 - protein, 120 aa, Homo sapiens
TTYRLSSEARCLMEQFGGPAGLSLASTDVGTGTDPGTLFQPPTALRFPLRCATSGTSLLGRSPCFWDLPAPVLWVVSSVLCQANRMSSQILSMKLFHRRGVQACLDHACVKLCTVQASYT

SEQ ID NO: 1031386 - protein, 120 aa, Homo sapiens; identical to SEQ ID NO: 1031385

SEQ ID NO: 1031387 - protein, 120 aa, Homo sapiens; identical to SEQ ID NO: 1031385

SEQ ID NO: 1031388 - protein, 120 aa, Homo sapiens; identical to SEQ ID NO: 1031385

SEQ ID NO: 1031389 - protein, 120 aa, Homo sapiens; identical to SEQ ID NO: 1031385

SEQ ID NO: 1031390 - protein, 120 aa, Homo sapiens; identical to SEQ ID NO: 1031385

SEQ ID NO: 1031391 - protein, 152 aa, Homo sapiens
MWLWKGVSPAFYPRDAGRGRKAAEGYEASPEDAKPAWRPRLSFQDNQGKPAEDEWGKTPDAMKAAMALEKKLNQALLGSLNPRVLQPTDTPISVTSVETHFLDEEVKLIKKMGDHLNKPQRLGAPKLAFSKILRKGTLTRLKSFGPKLSKAP

SEQ ID NO: 1031392 - protein, 120 aa, Homo sapiens; identical to SEQ ID NO: 1031385

SEQ ID NO: 1031393 - protein, 171 aa, Homo sapiens
TTYRLSSEARCLMEQFGGPAGLSLASTDVGTGTDPGTLFQPPTALRFPLRLGRSPPGTDSVRRVHPSCVSWEPWHSIRFSRWIRRPFVGAIQAMKPPRSAITKSYSRERVLRHGVNRCWFDQYRAGLLHLASLVGFYFDRDDVALEGREPSFLSARCWPRKKSSRGLRGVS

SEQ ID NO: 1031394 - protein, 115 aa, Homo sapiens
MRFCACVSMLRSKGPAGLSLASTDVGTGTDPGTLFQPPTALRFPLRLQTPGASSRPSPAVWELTAPVLWVVSSVLCQANRMSSQILSMKLFHRRGVQACLDHACVKLCTVQASYT

SEQ ID NO: 1031395 - protein, 105 aa, Homo sapiens
SEPFERYSPSPAPGTQPVEVGQVSPILLDKLHFLIQGYEASPEDAKPAWRPRLSFQDNQGKPAEDEWGKTPDAMKAAMALEKKLNQALLDLHCPWVSCPHGPPSL

SEQ ID NO: 1031396 - protein, 131 aa, Homo sapiens
MWLWKGVSPAFYPRDAGRGRKAAEGYEASPEDAKPAWRPRLSFQDNQGKPAEDEWGKTPDAMKAAMALEKKLNQALLDLHCPWVSCPHGEGPHLWNSWRCILDESEVSEDGDTEQLQVVASGGILSKSSRR

SEQ ID NO: 1031397 - protein, 105 aa, Homo sapiens
MGVENRPGDARARVCSACLANRHLGGVIALGDGHTPPSSSLTLPWYDIELSYDDSRCGSFHSDERLRSHTPGLELVAHGKSRRRTSDLDEDSGGKAHSQARLRAF

SEQ ID NO: 1031398 - protein, 120 aa, Homo sapiens; identical to SEQ ID NO: 1031385

SEQ ID NO: 1031399 - protein, 120 aa, Homo sapiens; identical to SEQ ID NO: 1031385

SEQ ID NO: 1031400 - protein, 120 aa, Homo sapiens; identical to SEQ ID NO: 1031385

SEQ ID NO: 1031401 - protein, 120 aa, Homo sapiens; identical to SEQ ID NO: 1031385

SEQ ID NO: 1031402 - protein, 120 aa, Homo sapiens; identical to SEQ ID NO: 1031385

SEQ ID NO: 1031403 - protein, 115 aa, Homo sapiens; identical to SEQ ID NO: 1031394

SEQ ID NO: 1031404 - protein, 116 aa, Homo sapiens
TTYRLSSEARCLMEQFGGPAGLSLASTDVGTGTDPGTLFQPPTALRFPLRCATSGTSLLGRSPCFWDLPRLAVFYVVITTSHSLTQSRTPWSSQIPWRDYLHRTVVVQTSHKSAGC

SEQ ID NO: 1031405 - protein, 86 aa, Homo sapiens
SEGTTREGDSVSEDKRQGVYAVSGRTSRRELKMSGVRTRDASAMKSLPLALEKKAEPGPCWIFIARGFLARTDPHLCDFRGDSLPR

SEQ ID NO: 1031406 - protein, 78 aa, Homo sapiens
SSGTVACWLSELASLCHVWSSTPISVTSVETHFLDEEVKLIKKMGDHLNQPPQAGWPGGWAGRVSLRKAHSQARLRAF

SEQ ID NO: 1031407 - protein, 121 aa, Homo sapiens
TTYRLSSEARCLMEQFGGPAGLSLASTDVGTGTDPGTLFQPPTALRFPLRCANLPGTHLLRPIFPWHFLGEPLGPKVQTPGVTLTDLPGGVSRGRVLHLTRGPLMSPHQNFYFAVFVGAPT

SEQ ID NO: 1031408 - protein, 166 aa, Homo sapiens
MPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031409 - protein, 198 aa, Homo sapiens
TRGSTHAARRRPRCNFLRSSRIRVHPTPAASTMPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031410 - protein, 198 aa, Homo sapiens; identical to SEQ ID NO: 1031409

SEQ ID NO: 1031411 - protein, 205 aa, Homo sapiens
PLRLVRGWVWNRPTARRRPRCNFLRSSRIRVHPTPAASTMPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031412 - protein, 126 aa, Homo sapiens
ASALIIKALKDHLNLGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031413 - protein, 259 aa, Homo sapiens
MVCRSVRCFNSVTGLWGLYLRSGVAGSTKQRSTMPPKFDPNEIKVVYLRCTGGEWSVPLLPWPPRSAPWVCLQKKLVMTIAKATGDWKGLRITVKLTIQNRQAQIEVVPSASALIIKALKEPPRDRKKQKNIKHSAETSLSSLLSLWGCKKIPPGEITAKSACSGRDGMRAGGPRPIPSRGARGRVLTKSAEGDHKLTMAAKGHLSSGHLNTSFFQKTWAVVEECPSNAVKKRNSGQPIPLWNLKKRGVLKHGKGIAAY

SEQ ID NO: 1031414 - protein, 203 aa, Homo sapiens
RPPTTTKFAAASARRRPRCNFLRSSRIRVHPTPAASTMPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031415 - protein, 214 aa, Homo sapiens
MHRTSRVESDEASLSLSLSLSLSARRRPRCNFLRSSRIRVHPTPAASTMPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031416 - protein, 166 aa, Homo sapiens; identical to SEQ ID NO: 1031408

SEQ ID NO: 1031417 - protein, 166 aa, Homo sapiens; identical to SEQ ID NO: 1031408

SEQ ID NO: 1031418 - protein, 166 aa, Homo sapiens; identical to SEQ ID NO: 1031408

SEQ ID NO: 1031419 - protein, 166 aa, Homo sapiens; identical to SEQ ID NO: 1031408

SEQ ID NO: 1031420 - protein, 166 aa, Homo sapiens; identical to SEQ ID NO: 1031408

SEQ ID NO: 1031421 - protein, 166 aa, Homo sapiens
DLLLCVDLLLCVDLLLCVDLLLCVDLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031422 - protein, 124 aa, Homo sapiens
MVGATSALAPKIGPLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031423 - protein, 205 aa, Homo sapiens; identical to SEQ ID NO: 1031411

SEQ ID NO: 1031424 - protein, 166 aa, Homo sapiens; identical to SEQ ID NO: 1031408

SEQ ID NO: 1031425 - protein, 127 aa, Homo sapiens
GGRGRVAHTDRLERPEFLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031426 - protein, 115 aa, Homo sapiens
RTTAPNERPDPLPLKEEKRLIMLVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031427 - protein, 166 aa, Homo sapiens; identical to SEQ ID NO: 1031408

SEQ ID NO: 1031428 - protein, 166 aa, Homo sapiens; identical to SEQ ID NO: 1031408

SEQ ID NO: 1031429 - protein, 166 aa, Homo sapiens; identical to SEQ ID NO: 1031408

SEQ ID NO: 1031430 - protein, 166 aa, Homo sapiens; identical to SEQ ID NO: 1031408

SEQ ID NO: 1031431 - protein, 166 aa, Homo sapiens; identical to SEQ ID NO: 1031408

SEQ ID NO: 1031432 - protein, 166 aa, Homo sapiens; identical to SEQ ID NO: 1031408

SEQ ID NO: 1031433 - protein, 187 aa, Homo sapiens
RLDEASQSLSSRIGHRHQPLTMPRKIDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031434 - protein, 191 aa, Homo sapiens
RAGKELEPPGGLARRRPRCNFLRSSRIRVHPTPAASTMPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGQMRHRSLARELSGTIKEILGTAQSVGCNVDGRHPHDIIDDINSGAVECPAS

SEQ ID NO: 1031435 - protein, 165 aa, Homo sapiens [sequence omitted]

SEQ ID NO: 1031436 - protein, 220 aa, Homo sapiens
DPSGETVTVLWDLYNDLSPLRSQILMLGPARRRPRCNFLRSSRIRVHPTPAASTMPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1031437 - protein, 154 aa, Homo sapiens
MPPKFDPNEIKVVYLRCTGGEGSVPLLPWPPRSAPWVCLQKKLVMTIAKATGDWKGLRITVKLTIQNRQAQIEVVPSASALIIKALKEPPRDRKKQKNIKHSGQMRHRSLARELSGTIKEILGTAQSVGCNVDGRHPHDIIDDINSGAVECPAS

SEQ ID NO: 1031438 - protein, 1183 aa, Homo sapiens
PLCDRRAYLAMRRGLLRATTAALLLEAQAASGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYLQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHEQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 1031439 - protein, 1183 aa, Homo sapiens; identical to SEQ ID NO: 1031438

SEQ ID NO: 1031440 - protein, 1183 aa, Homo sapiens; identical to SEQ ID NO: 1031438

SEQ ID NO: 1031441 - protein, 1183 aa, Homo sapiens; identical to SEQ ID NO: 1031438

SEQ ID NO: 1031442 - protein, 114 aa, Homo sapiens
MSASNPRPRGPRPSGEDGWELQTCPPGGSRGPSSLWSPTLGCRLPVSLPWSPSPLWAQGHQPGSVLTLLLHPALVSAATTPASTLRALHVPLTPGGWQVEVSGCWRLCKGRTLT

SEQ ID NO: 1031443 - protein, 368 aa, Homo sapiens
PLCDRRAYLAMRRGLLRATTAALLLEAQAASGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYLQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTVWTLGTVWTLGTVWTLGTVWTLGTVWTLGTVWTLGTVWTLGTV

SEQ ID NO: 1031444 - protein, 1183 aa, Homo sapiens; identical to SEQ ID NO: 1031438

SEQ ID NO: 1031445 - protein, 1183 aa, Homo sapiens; identical to SEQ ID NO: 1031438

SEQ ID NO: 1031446 - protein, 1183 aa, Homo sapiens; identical to SEQ ID NO: 1031438

SEQ ID NO: 1031447 - protein, 5065 aa, Homo sapiens
MAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLNPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAELSATLEQAAATARVTFSGLRDTVTPGELLKAEIIDQDLYERLEHGQATAKDVGSLASAQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTALVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPAENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSDCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWVLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEPVPAGVVGSEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDARRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRASTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 1031448 - protein, 559 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031449 - protein, 542 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031450 - protein, 559 aa, Homo sapiens; identical to SEQ ID NO: 1031448

SEQ ID NO: 1031451 - protein, 559 aa, Homo sapiens; identical to SEQ ID NO: 1031448

SEQ ID NO: 1031452 - protein, 516 aa, Homo sapiens
MENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031453 - protein, 516 aa, Homo sapiens; identical to SEQ ID NO: 1031452

SEQ ID NO: 1031454 - protein, 494 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031455 - protein, 550 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031456 - protein, 525 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEGGGWRINVRVLGGFHKPLKT

SEQ ID NO: 1031457 - protein, 499 aa, Homo sapiens
MENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031458 - protein, 579 aa, Homo sapiens
MEQLNLADSGLVGKEARRCRRASPPMGMPSAWWLQNEAGCLFAARQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031459 - protein, 443 aa, Homo sapiens [sequence omitted]

SEQ ID NO: 1031460 - protein, 425 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILARTSSVGSYGCPVGGGSRIFV

SEQ ID NO: 1031461 - protein, 582 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVRQGSQGLDPHALQACHPRKPFCGRACVDRSFHLTGIFTQVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031462 - protein, 302 aa, Homo sapiens
MSRRGDDASHDVSLKHAGLSSPETPPAQEGPALSPASWGRASGRRTDSVFSKKGREEKRSSGRKGDGRRRVLRTPASATRRDTPDSSPAAHAPETPEVRGPRPSPGQEHAPSVAPPGGVYRSSPPRKRVLTSFLARVPCTGTQIARDSGRSKSGRRARRPRRTQDGDGDHSSPGQWPARRGVRAGGGGGSGGSGRQMETSTGHRLHQDGERAEHSRQAGAASPDARAAGGPSEGQEVRHGAEHQECAGEADHRAPAAAAHQPADGSSDNGLWRSSLTFAIDGGSAAAGAGHHVPRLRGLYLL

SEQ ID NO: 1031463 - protein, 347 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAGSHELLTGGSLAVECNGCYTQAGPPPVGGLPANSEGGRGRQRAEGRLREDGERRIRSQRLKTHR

SEQ ID NO: 1031464 - protein, 382 aa, Homo sapiens
MSRRGDDASHDVSLKHAGLSSPETPPAQEGPALSPASWGRASGRRTDSVFSKKGREEKRSSGRKGDGRRRVLRTPASATRRDTPDSSPAAHAPETPEVRGPRPSPGQEHAPSVAPPGGVYRSSPPRKRVLTSFLREFRAPAPRSRETAEGARVGGARGGRDGRKMATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKGGAGPQPTNRGQGPTPI

SEQ ID NO: 1031465 - protein, 318 aa, Homo sapiens
MSRRGDDASHDVSLKHAGLSSPETPPAQEGPALSPASWGRASGRRTDSVFSKKGREEKRSSGRKGDGRRRVLRTPASATRRDTPDSSPAAHAPETPEVRGPRPSPGQEHAPSVAPPGGVYRSSPPRKRVLTSFLREFRAPAPRSRETAEGARVGGARGGRDGRKMATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPLPL

SEQ ID NO: 1031466 - protein, 335 aa, Homo sapiens
MSRRGDDASHDVSLKHAGLSSPETPPAQEGPALSPASWGRASGRRTDSVFSKKGREEKRSSGRKGDGRRRVLRTPASATRRDTPDSSPAAHAPETPEVRGPRPSPGQEHAPSVAPPGGVYRSSPPRKRVLTSFLREFRAPAPRSRETAEGARVGGARGGRDGRKMATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSINRNAHFFRGSCPESGLEGGSAAHVLGTLLPWPVLPASSGRAQQSARRGGAGGVG

SEQ ID NO: 1031467 - protein, 559 aa, Homo sapiens; identical to SEQ ID NO: 1031448

SEQ ID NO: 1031468 - protein, 559 aa, Homo sapiens; identical to SEQ ID NO: 1031448

SEQ ID NO: 1031469 - protein, 560 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTLGSTQATGPAEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031470 - protein, 513 aa, Homo sapiens
MATATIALGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031471 - protein, 481 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESRRGGGCRNHCQDLCGVFHSL

SEQ ID NO: 1031472 - protein, 543 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLADLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031473 - protein, 469 aa, Homo sapiens
LSSSPGVSSGQWLPCLLTSSLLATKPMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031474 - protein, 543 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTQWEAQGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031475 - protein, 378 aa, Homo sapiens
MASKEGGPSRRRRRQWWQREVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031476 - protein, 327 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLNPARLEAPPAVWATQNHCRNRQKQAEQVRPEHCM

SEQ ID NO: 1031477 - protein, 233 aa, Homo sapiens
MPEVRGPRPSPGQEHAPSVAPPGGVYRSSPPRKRVLTSFLARVPCTGTQIARDSGRSKSGRRARRPRRTQDGDGDHSSPGQWPARRGVRAGGGGGSGGSGRQMETSTGHRLHQDGERAEHSRQAGAASPDARAAGGPSEGQEVRHGAEHHDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1031478 - protein, 516 aa, Homo sapiens; identical to SEQ ID NO: 1031452

SEQ ID NO: 1031479 - protein, 516 aa, Homo sapiens; identical to SEQ ID NO: 1031452

SEQ ID NO: 1031480 - protein, 516 aa, Homo sapiens; identical to SEQ ID NO: 1031452

SEQ ID NO: 1031481 - protein, 516 aa, Homo sapiens; identical to SEQ ID NO: 1031452

SEQ ID NO: 1031482 - protein, 160 aa, Homo sapiens [sequence omitted]

SEQ ID NO: 1031483 - protein, 160 aa, Homo sapiens [sequence omitted]

SEQ ID NO: 1031484 - protein, 160 aa, Homo sapiens [sequence omitted]

SEQ ID NO: 1031485 - protein, 160 aa, Homo sapiens [sequence omitted]

SEQ ID NO: 1031486 - protein, 160 aa, Homo sapiens [sequence omitted]

SEQ ID NO: 1031487 - protein, 160 aa, Homo sapiens [sequence omitted]

SEQ ID NO: 1031488 - protein, 160 aa, Homo sapiens [sequence omitted]

SEQ ID NO: 1031489 - protein, 160 aa, Homo sapiens [sequence omitted]

SEQ ID NO: 1031490 - protein, 106 aa, Homo sapiens
PYPSGSSKYSNENFEGRRVKGSRRVKGSRRVKGSRRVKGSRRVKGSRRVKGSRRVKGSRRVKGSRRVKGSRGLRAPGGLRAPGGLRAPGGLRAPGGLRAPGGLRAP

SEQ ID NO: 1031491 - protein, 459 aa, Homo sapiens
AARGSGCATAGLPCPSAQAGGPGALVPAEAATVAPLLIMNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 1031492 - protein, 401 aa, Homo sapiens
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 1031493 - protein, 401 aa, Homo sapiens; identical to SEQ ID NO: 1031492

SEQ ID NO: 1031494 - protein, 459 aa, Homo sapiens; identical to SEQ ID NO: 1031491

SEQ ID NO: 1031495 - protein, 459 aa, Homo sapiens; identical to SEQ ID NO: 1031491

SEQ ID NO: 1031496 - protein, 459 aa, Homo sapiens; identical to SEQ ID NO: 1031491

SEQ ID NO: 1031497 - protein, 68 aa, Homo sapiens
SGTRLGLCHRWTPVSLRAGGRPRSAGAGRGGDGGAPPHHEQRLLPKKPHIPAQDLLPQDVILRGQGQA

SEQ ID NO: 1031498 - protein, 512 aa, Homo sapiens
AARGSGCATAGLPCPSAQAGGPGALVPAEAATVAPLLIMNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTLPTQGGQGGTIQEPGPKLTRLGQARDGATARTPSPTSRFWLAQPQPSPAALPRAG

SEQ ID NO: 1031499 - protein, 235 aa, Homo sapiens
SGTRLGLCHRWTPVSLRAGGRPRSAGAGRGGDGGAPPHHVVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 1031500 - protein, 459 aa, Homo sapiens; identical to SEQ ID NO: 1031491

SEQ ID NO: 1031501 - protein, 399 aa, Homo sapiens
AARGSGCATAGLPCPSAQAGGPGALVPAEAATVAPLLIMNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDANQDGWDGCSYLAFLSAVRPHQYSRAYNSYQGPEQRQLRSFIVIAHKS

SEQ ID NO: 1031502 - protein, 271 aa, Homo sapiens
AARGSGCATAGLPCPSAQAGGPGALVPAEAATVAPLLIMNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQCRWQVGAL

SEQ ID NO: 1031503 - protein, 421 aa, Homo sapiens
MNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 1031504 - protein, 401 aa, Homo sapiens; identical to SEQ ID NO: 1031492

SEQ ID NO: 1031505 - protein, 421 aa, Homo sapiens; identical to SEQ ID NO: 1031503

SEQ ID NO: 1031506 - protein, 401 aa, Homo sapiens; identical to SEQ ID NO: 1031492

SEQ ID NO: 1031507 - protein, 85 aa, Homo sapiens
MNTHPGEGAQLDAGRRRGCVLDKKREAPHRRGETHILNSEEDRGVRNTQANVEGRKQHWGGEDHQGEKQHTSGRGSTIRGRHNTE

SEQ ID NO: 1031508 - protein, 421 aa, Homo sapiens; identical to SEQ ID NO: 1031503

SEQ ID NO: 1031509 - protein, 401 aa, Homo sapiens; identical to SEQ ID NO: 1031492

SEQ ID NO: 1031510 - protein, 401 aa, Homo sapiens; identical to SEQ ID NO: 1031492

SEQ ID NO: 1031511 - protein, 211 aa, Homo sapiens [sequence omitted]

SEQ ID NO: 1031512 - protein, 264 aa, Homo sapiens
GESTVVTTSRCRHGSLRLLPSNAAHTDLVSSCGEMVCNQGARSEDSRTAMWNCSGVALRQGGGAAAALAAHGGEGVEQGAAQRAQSVVQVGPEPRRRTRSTARPKQLHKRQAQLLTRPRAGGARARGRAKRAASAGSRRGKGNRGDAQARRRPRSSRCTASARQPSAGSLRQRSKRGSSRRAQGPWKAVGSAAGPGSSSARRRASKARRRPGLLSASSPGSRRLRARLSSTASAVSAPSAGCGAATASATPSAAILPASAGHPA

SEQ ID NO: 1031513 - protein, 91 aa, Homo sapiens
EDTFREELVALVLDCGCGGVGPGMTCPHPPPTESLEKWERLTVADALEPVQFEDGEKIVVQGEPGDDFYIITEKNLPGVVAHACNPSYLGG

SEQ ID NO: 1031514 - protein, 381 aa, Homo sapiens
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 1031515 - protein, 442 aa, Homo sapiens
GGVGGAACLLLRRVGAGVEGGAAAVRGPARSLASRPRAPRPAQPPPGLGRRASRKEAATLAMASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 1031516 - protein, 376 aa, Homo sapiens
MGPPLPLLLLLLLLLPPRVLPAAPSSVPRGRQLPGRLGCLLEEGLCGASEACVKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 1031517 - protein, 154 aa, Homo sapiens
MQQQHWEQLCRLHSGPHHPVGDVVAQGREDLGEVPEDELPAAQHRAALMWRVMGWGGRGKVQLVLQVLLILLLPLQANVLPEAGSQLPDLRHLVVEATEQQRDELVEEGVTVTQTQQPAAHHGGHRPPDLRDVIKQSLSKMGKHGRRGREFSSS

SEQ ID NO: 1031518 - protein, 160 aa, Homo sapiens
MWACASSVAMAARCGWRASRGQPRMAEASTRRPEAEGVFFSVDKISFRNTSGLTNVPTSSADLVQLWTTAASSSVQAWNRVRRTTSRCCVAWSSACSSSTGSSCADFTRVPTTQSVMSWHRAGRILERFLKTSSRQPGVGPPRPPPPPAPPSCPRQPATP

SEQ ID NO: 1031519 - protein, 376 aa, Homo sapiens
GGVGGAACLLLRRVGAGVEGGAAAVRGPARSLASRPRAPRPAQPPPGLGRRASRKEAATLAMASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEKNLPGVVAHACNPSYLGG

SEQ ID NO: 1031520 - protein, 600 aa, Homo sapiens
GGVGGAACLLLRRVGAGVEGGAAAVRGPARSLASRPRAPRPAQPPPGLGRRASRKEAATLAMASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRSPLPVMETARRGAKAAYDVTQEFTFSDRVIHSYEVHGSKVSAWSDHVSGSAAGESHASLVVLRACEEEINLVCTKGKSPAGQNLYTFHRRDVLHSDPVTDERPVTAKEVTIFGRVGARSLLANHRRTYVSCVDDFGHRVAGNLGPRECGSALISGSCRGHHTKKWVVERREQTEAAGYLLKSGGGLGGVPLDVLWKDSHLDNGKPICEGVVTRRRLSRSTHFNPVTCRPFMFAPVRFAMYTQGVPPQHVLGSGRCGSPGVVYWLLKRGTRSWQDTYWLLDGWWCARGLPAVGGATGPVVAGCFRPYE

SEQ ID NO: 1031521 - protein, 154 aa, Homo sapiens; identical to SEQ ID NO: 1031517

SEQ ID NO: 1031522 - protein, 155 aa, Homo sapiens
MPLQIGGQDVLCHRLEVAGKLPLGVDGVRGSEQHGGQDGEQLQAHLRVLGGLQTGPQRGHDVWQGFSQGRACLRSQRELPLAAQTLPPGPRVCPPSASSCSLQGYFRPGHVSTFQARALLLADTSARSHVSALPALALLLAAGTLPRDHVSALPA

SEQ ID NO: 1031523 - protein, 442 aa, Homo sapiens; identical to SEQ ID NO: 1031515

SEQ ID NO: 1031524 - protein, 477 aa, Homo sapiens
GKALSSRLPVADMDHCACCLQMPLTRTLSVLVAKWSAIRGPRSEDSRTAMWNWSGVALRQGGGAAAALAAHGGEGVEQEQRSARRASSRKEAATLAMASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 1031525 - protein, 229 aa, Homo sapiens
MFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 1031526 - protein, 169 aa, Homo sapiens
MQQQHWEQLCRLHSGPHHPVGDVVAQGREDLGEVPEDELPAAQHRAALMWRVMGWGGRGKVQLVLQVLLILLLPLQANVLPEAGSQLPDLRHLVVEATEQQRDELVEEGVTVTQTQQPAAHHGGHRPPDLRMRGRDKDSCQRGCRGCRHGAALSAAIRTLPEAEARAGP

SEQ ID NO: 1031527 - protein, 379 aa, Homo sapiens
GGVGGAACLLLRRVGAGVEGGAAAVRGPARSLASRPRAPRPAQPPPGLGRRASRKEAATLAMASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGHRVPWLAARVPPQWEVTLGK

SEQ ID NO: 1031528 - protein, 154 aa, Homo sapiens; identical to SEQ ID NO: 1031517

SEQ ID NO: 1031529 - protein, 154 aa, Homo sapiens; identical to SEQ ID NO: 1031517

SEQ ID NO: 1031530 - protein, 100 aa, Homo sapiens
MAASDTERDGLAPEKTSPDRDKKKEQSEVSVSPRASKHHYSRSRSRSRERKRKSDNEGRKHRSRSRSKEGRRHESKDKSKNRSSFSSKTNTGLPAERHIR

SEQ ID NO: 1031531 - protein, 193 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSTTTHTNKSTSTTTQTKPPITSPSPSNSNTHPYHDNH

SEQ ID NO: 1031532 - protein, 206 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRRRDKKTGDQVSLPAQEITNSAGAHTGLHTGGLRTKRDV

SEQ ID NO: 1031533 - protein, 208 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSGTRKRGIRSRFPLKIKTTRHSDSDGSELGTRDGTEPTIR

SEQ ID NO: 1031534 - protein, 147 aa, Homo sapiens
MIRTNFFLKQGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRRRDKKTGDQVSLPAQEITNSAGAHTGLHTGGLRTKRDV

SEQ ID NO: 1031535 - protein, 131 aa, Homo sapiens
RQTACGTVGKQCCLYINYSEEIKSNIQRLHEASENLKNVPLLDWQGIFAKVGDWFRSWGYVLLIVLFCLFIFVLIYVRVFRKSRRSLNSQPLNLALSPQQSAQLLVSETSCQVSNRAMKGLTTHQYDTSLL

SEQ ID NO: 1031536 - protein, 143 aa, Homo sapiens
AHECAHPLPSSTAAASFFCRSWCCLCARLVRTWYLFCEAAAEETPALAMADEKPKEGVKTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 1031537 - protein, 134 aa, Homo sapiens
AHECAHPLPSSTAAASFFCRSWCCLCARLVRTWYLFCEAGKTPGLRKPELTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 1031538 - protein, 143 aa, Homo sapiens; identical to SEQ ID NO: 1031536

SEQ ID NO: 1031539 - protein, 158 aa, Homo sapiens [sequence omitted]

SEQ ID NO: 1031540 - protein, 162 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRSFPDFCLSPFPFPFLDGFVFL

SEQ ID NO: 1031541 - protein, 219 aa, Homo sapiens; identical to SEQ ID NO: 897559

SEQ ID NO: 1031542 - protein, 265 aa, Homo sapiens
MVKYFLGQSVLRSSWDQVFAAFWQRYPNPYSVVRQEEAAVWELGGILELEILFLCPWRFPGVQEIMRSIPARRQESSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGEAPSKTLVETAKEAKEKAKETALAATEKAKDLASKAATKKQQQQQQFV

SEQ ID NO: 1031543 - protein, 161 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRPFPIFGLARFFPGLHQSFRG

SEQ ID NO: 1031544 - protein, 296 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGKLGWSFRHLLKAATCRSRQARPLPKHLLRQPRKPRRRQRRRHWQLQRRPRTSPARRPPRSSSSSNSLCSQSTTTTAPQTARLSPSALPSLYFIIKNQLPALSAVYVVGCGDAVWHLQYTKHMIHV

SEQ ID NO: 1031545 - protein, 147 aa, Homo sapiens
MIPPLLSRRRGRRLHAEFAAERDWEQFHQPRNLLLALVGEVGELAELFQWKTDGEPGPQGWSPRERAALQEELSDVLIYLVALAARCRVDLPLAVLSKMDINRRRYPAHLARSSSRKYTELPHGAISEDQAVGPADIPCDSTGQTST

SEQ ID NO: 1031546 - protein, 205 aa, Homo sapiens
LVWPGSYGIFERGSWVFREVAVQRWAACLWPVGRFVGTRGERTLLLPAGSASARSPRSRTCKQAWPSSGRRLHAEFAAERDWEQFHQPRNLLLALVGEVGELAELFQWKTDGEPGPQGWSPRERAALQEELSDVLIYLVALAARCRVDLPLAVLSKMDINRRRYPAHLARSSSRKYTELPHGAISEDQAVGPADIPCDSTGQTST

SEQ ID NO: 1031547 - protein, 100 aa, Homo sapiens
WGDSVVDTGGRRDTDCFPERVHAIKTPVRPHSIEMTNPYAYPNAVTVLLVYLNDRLWVDISKSSLRGILPSMGTLCMCGRCVVEYGQETIHLYDVMEKEL

SEQ ID NO: 1031548 - protein, 170 aa, Homo sapiens
MSVAGGEIRGDTGGEDTAAPGRFSFSPEPTLEDIRRLHAEFAAERDWEQFHQPRNLLLALVGEVGELAELFQWKTDGEPGPQGWSPRERAALQEELSDVLIYLVALAARCRVDLPLAVLSKMDINRRRYPAHLARSSSRKYTELPHGAISEDQAVGPADIPCDSTGQTST

SEQ ID NO: 1031549 - protein, 170 aa, Homo sapiens; identical to SEQ ID NO: 1031548

SEQ ID NO: 1031550 - protein, 371 aa, Homo sapiens
MLGSRAAGFARGLRALALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQIYTLDIHRPEDCWNKFISNRTLGLIVFLGIVLGNLWKEKKTDKTKKGIENKIEN

SEQ ID NO: 1031551 - protein, 344 aa, Homo sapiens
GRGMTSIRARPGLTSAMLGSRAAGFARGLRALALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQKWGLEILPRLV

SEQ ID NO: 1031552 - protein, 229 aa, Homo sapiens
GRGMTSIRARPGLTSAMLGSRAAGFARGLRALALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGQKR

SEQ ID NO: 1031553 - protein, 113 aa, Homo sapiens
GRGMTSIRARPGLTSAMLGSRAAGFARGLRALALAWLPGWRGRSFALARAAGAPHGGDLQPPACPEPRGRQLSLSAAAVVDSAPRPLQPYLRLMRLDKPIGECGRAGSPGICK

SEQ ID NO: 1031554 - protein, 299 aa, Homo sapiens
LPSFTDETKTYSLKILYCLVSLNLQVADIELRSLLTFPFTVGTLVICRGALQIPIRTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQKWGLEILPRLV

SEQ ID NO: 1031555 - protein, 378 aa, Homo sapiens
GRGMTSIRARPGLTSAMLGSRAAGFARGLRALALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQIYTLDIHRPEDCWNKFISNRTLGLIVFLGIVLGNLWKERRRQQEV

SEQ ID NO: 1031556 - protein, 371 aa, Homo sapiens; identical to SEQ ID NO: 1031550

SEQ ID NO: 1031557 - protein, 344 aa, Homo sapiens; identical to SEQ ID NO: 1031551

SEQ ID NO: 1031558 - protein, 344 aa, Homo sapiens; identical to SEQ ID NO: 1031551

SEQ ID NO: 1031559 - protein, 81 aa, Homo sapiens
SPTEKALKLWALPSSLSLRPVEDGQPETRRAWPHAFRQVPSEWLVELGKLEEKMKALMMEKEQLQQQLQQHGPVSCTCCVL

SEQ ID NO: 1031560 - protein, 81 aa, Homo sapiens; identical to SEQ ID NO: 1031559

SEQ ID NO: 1031561 - protein, 177 aa, Homo sapiens
AVQKAAPGSQRYSQTGNYELAVALSRWVFKEEGVLRVGVHRVGENYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 1031562 - protein, 129 aa, Homo sapiens
MWSCTLYLYPFFLYCGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 1031563 - protein, 303 aa, Homo sapiens
SVSNPRGYVARPGWRAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVFTRVRWWEGLPSGPTCQVPESGRPGGTGPREPVGVRPKFRRAIG

SEQ ID NO: 1031564 - protein, 90 aa, Homo sapiens
MVTKTKIDNMGLIKLKSFCIARRNYHQSEQATYRMGENFCIYSSDKRLISRIAPKSRIAPKSRIAPKSRIAPKSRIAPKSRIAPKSRIAP

SEQ ID NO: 1031565 - protein, 837 aa, Homo sapiens
SPRAAPSESRSRWVQMAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031566 - protein, 835 aa, Homo sapiens
SVSNPRGYVARPGWRAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031567 - protein, 836 aa, Homo sapiens
MPRSVLGFISSRGHGCGSCGGASEPPSSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031568 - protein, 864 aa, Homo sapiens
MPRSVLGFISSRGHGCGSCGGASEQREELAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFLRGPNTPPPKKNSFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031569 - protein, 846 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCSWPHGLP

SEQ ID NO: 1031570 - protein, 562 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGSRAPSGVHRTSSACWSASTAARTSSSMSTARCWPTACCTSSASAPSGRSATWSC

SEQ ID NO: 1031571 - protein, 481 aa, Homo sapiens
MGGQGNEAAVGTCETTYRHGQLSTRVLPLGGCGPGYCMAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031572 - protein, 412 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLTGCPGDSAPASRRQHV

SEQ ID NO: 1031573 - protein, 410 aa, Homo sapiens
SPRAAPSESRSRWVQMAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLGVVCPDGHALAPSGSPLLPWVQLASAESWGAVLITRNMTERESQGFLCSVSWTQVSLFCHSPSVPQIHALTLVRPYVACVCSSKFLSNSKLPGLCRIPLCLLSILGRNDSHPRRHSLPCNCEQKLAAASLQEDQVTVRASSLLSVLER

SEQ ID NO: 1031574 - protein, 221 aa, Homo sapiens
SPRAAPSESRSRWVQMAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPARPCPRMHC

SEQ ID NO: 1031575 - protein, 270 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQARVVHGAADSNMWSRSSIPIAGYRRCDVRQFTPSG

SEQ ID NO: 1031576 - protein, 840 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031577 - protein, 834 aa, Homo sapiens
MKSRGVTCNVILYVGLVVVVAWLQFYTAGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031578 - protein, 919 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQGEPTSPYAGLPRPHGPAVGEGLFPSEGVVWGSCASRRHPSLSHGQGRVAREPPDLSADGRQGRCSPCPGCPASPVTLHAASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031579 - protein, 867 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLVRVQAHGGPGGGGEACRCLTGAGLCPQLFWTYIQAMLTNLESLSLDRIYNMLRMFVVTGPALAEIDLQELQGYLQKKVRDQQLVYSAGVYRLPKNCS

SEQ ID NO: 1031580 - protein, 557 aa, Homo sapiens
GGCSSPALAAGLTMPPCMLTLAVLLQWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031581 - protein, 589 aa, Homo sapiens
NERQGENNKKHTARYEAGCWAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFRIAPKSRIAPKSRIAPKSRIAPKSRIAPKSRIAPKSRIAP

SEQ ID NO: 1031582 - protein, 197 aa, Homo sapiens
MVAEQAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 1031583 - protein, 548 aa, Homo sapiens
MVAHDETGGLLPIKRTIRVLDVNNQSFREQEEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALLVANGKRLWCREGSVC

SEQ ID NO: 1031584 - protein, 116 aa, Homo sapiens
TGTVRIDIRSVGYTGVLNINFEERVNPEVPCIYIDKLEYLDEKQRDPRIEASKVLLCHGELRSKSGHKPFNQFFSPWVFHTNEFFEDILDLQDPDQPRENVKRVNLFNQDVTRVRP

SEQ ID NO: 1031585 - protein, 548 aa, Homo sapiens; identical to SEQ ID NO: 1031583

SEQ ID NO: 1031586 - protein, 233 aa, Homo sapiens
MVAHDETGGLLPIKRTIRVLDVNNQSFREQEEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWWQPKLFLIKRNRIQESKTSSSDVSSLPSVEN

SEQ ID NO: 1031587 - protein, 151 aa, Homo sapiens
MEPELAAQKQPRPRSEAAGPLGSARRERRGLRDTSGSRLDGRCSLRRGSSFTFLTPGPNCDFTLKRKRREKDDDVVSLSSLDLKEPSNKRVRPLARVTSLANLISPVRNGAVRRFGQTIQSFTLRGDHRSPASAQKFSSRSTVPTPAKRRS

SEQ ID NO: 1031588 - protein, 548 aa, Homo sapiens; identical to SEQ ID NO: 1031583

SEQ ID NO: 1031589 - protein, 418 aa, Homo sapiens
MVAHDETGGLLPIKRTIRVLDVNNQSFREQEEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKGKMQPFNNLKK

SEQ ID NO: 1031590 - protein, 228 aa, Homo sapiens [sequence omitted]

SEQ ID NO: 1031591 - protein, 322 aa, Homo sapiens
MVAHDETGGLLPIKRTIRVLDVNNQSFREQEEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYHINKQKNNNPKS

SEQ ID NO: 1031592 - protein, 387 aa, Homo sapiens
MSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALSGGKRKETLV

SEQ ID NO: 1031593 - protein, 418 aa, Homo sapiens; identical to SEQ ID NO: 1031589

SEQ ID NO: 1031594 - protein, 151 aa, Homo sapiens; identical to SEQ ID NO: 1031587

SEQ ID NO: 1031595 - protein, 151 aa, Homo sapiens; identical to SEQ ID NO: 1031587

SEQ ID NO: 1031596 - protein, 460 aa, Homo sapiens
MDGWPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALLVANGKRLWCREGSVC

SEQ ID NO: 1031597 - protein, 149 aa, Homo sapiens
MRVVLPEPSSPKTRMFLPDGSLDLARVDTSLRMEDHRLWPSSSSLVRSPAAATAGPLGPSSSFFSTPTGAILPTAATKRALPRARRGPARTRAGQPPARRPSRRAARRPCRGDCAAQRVLWSAMATGSHGLRGRRGGGGGQAAAGAAMR

SEQ ID NO: 1031598 - protein, 82 aa, Homo sapiens
MRVVLPEPSSPKTRMFLPDGSLDLARVDTSLRMEDHRLWPSSSSLVRSPAAATAGPLGCIDTSCCGTARDLVPSHRKVSSVS

SEQ ID NO: 1031599 - protein, 144 aa, Homo sapiens
VSAAFMKKYIHVATIIRPVLTQESDTYISRGVFTLRSRDSMSSDTARHLQLQPEHWNSDSTGHSPCEARMSKTVDLQDAKEAVELVQYAYFKKVLEKEKKRKKRSKDESETEDEEEKAKRPGAEEERGDSAQPDAKDGDSYDPY

SEQ ID NO: 1031600 - protein, 519 aa, Homo sapiens
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSTADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 1031601 - protein, 626 aa, Homo sapiens
RSLAGAPRRAEGAGLRNAKRRARDPARRPRAHVSAMRRRAARGPGPPPPGPGLSRLPLLPLPLLLLLALGTRGGCAAPEPARRAEDLSLGVEWLSRFGYLPPADPTTGQLQTQEELSKAITAMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSTADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPNWIPSEVVLRAGIARGRRSCDLVPTPAPDVTGPPRKDVPHRCSTHFDAVAQIRGEAFFFKGKYFWRLTRDRHLVSLQPAQMHRFWRGLPLHLDSVDAVYERTSDHKIVFFKGTSCTGATMTTRGTWTPATPPRAPCGGVSPARWTTPCAGPTVPPTSSVARSTGKCWMASWRWHPGTHSPRPGTGWCVETHRPMDLWLRAWTRQRGPAPLQDNMTRAARRTVTRSAHAPLGHPLPRGPQAHWWLPPCCCCCRHCHQAPCGQRPRP

SEQ ID NO: 1031602 - protein, 244 aa, Homo sapiens
AVPSSPGEGPGQGRLTQEKERQELLPFGVGPSRATKLFLSPPGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 1031603 - protein, 605 aa, Homo sapiens
MRRRAARGPGPPPPGPGLSRLPLLPLPLLLLLALGTRGGCAAPEPARRAEDLSLGVEWLSRFGYLPPADPTTGQLQTQEELSKAITAMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSTADIQIDFSKADHNDGYPFDARRHRAHAFFPGHHHTAGYTHFNDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 1031604 - protein, 186 aa, Homo sapiens
RDFTVSALHGMDQKERDVIMREFRSGSSRVLITTDLLARGIDVQQVSLVINYDLPTNRENYIHRIGRGGRFGRKGVAINFVTEEDKRILRHTDTLNNTTVEEMPPHAAPPPPPLGSLTQRSLSPTPPPPPPPPPPPTPLPTPPPPPPPPPPPPPPPPPPPPPPPPPPPPHPHRWPTPPPPIYFPVL

SEQ ID NO: 1031605 - protein, 111 aa, Homo sapiens
RDFTVSALHGMDQKERDVIMREFRSGSSRVLITTDLLARGIDVQQVSLVINYDLPTNRENYIHRIGRGGRFGRKGVAINFVTEEDKRILRHTDTLNNTTVEEMPMNVAALI

SEQ ID NO: 1031606 - protein, 417 aa, Homo sapiens
MAVETTVHTHLSASPPQGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATLSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 1031607 - protein, 400 aa, Homo sapiens
APPIMFYCLWVSRSPAFLTLYSFNGPITGTDNGHKRRAGGPGFPKCLPNPPQTDSMTPPWLEYDGGAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATLSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 1031608 - protein, 117 aa, Homo sapiens
MAVETTVHTHLSASPPQGSPYDHTPGMAGSLGYHPYAAPLGSYPYGDPAYRKNATRDATATLKAWLNEHRKNPYPTKGEKIMLAIITKMTLTQVSTWFANARRRLKKENKMTTGAPN

SEQ ID NO: 1031609 - protein, 86 aa, Homo sapiens
MAFVLWLLSPYTKGASLLYRKFVHPSLSRHEKVPHGEAGTGGLGVGMRERALDLGFRMLGTPGFYPSPAAIEGQDLDRAQPTSSSG

SEQ ID NO: 1031610 - protein, 257 aa, Homo sapiens
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKSQGALAGRLQSFSMQDLRSISDAPAPAYHDPLYLEDQVSHRRPPIGYRAGGLQDSDTEDECWSDTEAVPRAPARPREKPLIRSQSLRVVKRKPPVREGTSRSLKVRTRKKTVPSDVDS

SEQ ID NO: 1031611 - protein, 160 aa, Homo sapiens
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYRDRAQLREAGPQHCRLRCCAGCHQESGGAGRQAAELLHAGPALHL

SEQ ID NO: 1031612 - protein, 160 aa, Homo sapiens; identical to SEQ ID NO: 1031611

SEQ ID NO: 1031613 - protein, 94 aa, Homo sapiens
ASRSPGVGQHSVPCNFQVSCELRPVGRCWWPGALEPRRPAPARDQQQGPSARFSAAERAGGSCNCPGRGARPLPSRLPPRRGRFASGLPILQVP

SEQ ID NO: 1031614 - protein, 145 aa, Homo sapiens
FAPPGPLNPILSPPPSKPRGKGIKGGSPQSGGPNPFGVIPGGPGGAFHGQGRRKGNVFFFCIFFCIFCHPCTGLSGSFAGMTHTDTFIDTMDTGRLRCRLKGRHIHLTGGLTLPPSFSTVYFTVNVWYIVTCGHSRLVTRHKCVL

SEQ ID NO: 1031615 - protein, 91 aa, Homo sapiens
MVSWMICRLVVEYGRPQTSSTPGCRPAPVVEAVDVYWEEELFELHPPALHARVNGPVGLHAVFGGTAGYPPPQASLAENDPCRTPHTLQTL

SEQ ID NO: 1031616 - protein, 160 aa, Homo sapiens; identical to SEQ ID NO: 1031611

SEQ ID NO: 1031617 - protein, 160 aa, Homo sapiens; identical to SEQ ID NO: 1031611

SEQ ID NO: 1031618 - protein, 160 aa, Homo sapiens; identical to SEQ ID NO: 1031611

SEQ ID NO: 1031619 - protein, 105 aa, Homo sapiens [sequence omitted]

SEQ ID NO: 1031620 - protein, 257 aa, Homo sapiens; identical to SEQ ID NO: 1031610

SEQ ID NO: 1031621 - protein, 143 aa, Homo sapiens [sequence omitted]

SEQ ID NO: 1031622 - protein, 114 aa, Homo sapiens
KGPALAFILWPPTKHCLSCAQAMLQGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 1031623 - protein, 65 aa, Homo sapiens
KRPLLSSCGLPPSTASAVAGYAPGEIDGKALLLLRSDMMMKYMGLKLGPALKLSYHIDRLKQGKF

SEQ ID NO: 1031624 - protein, 114 aa, Homo sapiens; identical to SEQ ID NO: 1031622

SEQ ID NO: 1031625 - protein, 114 aa, Homo sapiens; identical to SEQ ID NO: 1031622

SEQ ID NO: 1031626 - protein, 114 aa, Homo sapiens; identical to SEQ ID NO: 1031622

SEQ ID NO: 1031627 - protein, 236 aa, Homo sapiens
MDVCEWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLEFIVIQQGRLVDQNLNKIGKMNASND

SEQ ID NO: 1031628 - protein, 374 aa, Homo sapiens
MDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLEFIVIQQGRLVDQNLNKIGKMNASND

SEQ ID NO: 1031629 - protein, 106 aa, Homo sapiens
TLGKPLDIGLGKDFMTKNPKANAIKTKINSWDLIKLKSFCMAKGTVSRVNRQPTEWEKIFTIYTSDKGLISRIYNKIKQISKKKNNHIKKWAKDMNDNSKKKTYKW

SEQ ID NO: 1031630 - protein, 119 aa, Homo sapiens
MTTGAKASLPSTQCLRMPSRMLGGKWMCRSQRNTMLLASSTASTPACSPAERSKFPVRLRYWYRGRRAARRARSTSISSLSKSTRTTLKRESPVRACSAAMSARNCATHRAWFFTGTMK

SEQ ID NO: 1031631 - protein, 247 aa, Homo sapiens
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 1031632 - protein, 555 aa, Homo sapiens
KEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSEYCGQSEAPAVQCHPYCDVDAHVNEAHPRPACPAAGPPPEAISPAVCPQAHHCSTLPCSRGCSATDQGPWQTLGDQLYLLYFICVCSGGEPSGSLSLVVNNLLIDNLYP

SEQ ID NO: 1031633 - protein, 376 aa, Homo sapiens
KEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSLPCRRPPTRSHLPRCVSPGASLLHSPLQPRLLGH

SEQ ID NO: 1031634 - protein, 555 aa, Homo sapiens; identical to SEQ ID NO: 1031632

SEQ ID NO: 1031635 - protein, 555 aa, Homo sapiens; identical to SEQ ID NO: 1031632

SEQ ID NO: 1031636 - protein, 341 aa, Homo sapiens
MPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMEEGHFDADGNYFLNRDAQIRDSWLDNIDWVKIRERPPGQRQASDSEEEDSLGQTSMSAQALLEGLLELLLPRETVAGALRRLGARGGGKGRKGPGQPSSPQRLDRLSGLADQMVARGNLGVYQETRERLAMRLKGLGCQTLGPHNPTPPPSLDMFAEELAEEELETPTPTQRGEAESRGDGLVDVMWEYKWENTGDAELYGPFTSAQMQTWVSEGYFPDGVYCRKLDPPGGQFYNSKRIDFDLYT

SEQ ID NO: 1031637 - protein, 341 aa, Homo sapiens; identical to SEQ ID NO: 1031636

SEQ ID NO: 1031638 - protein, 107 aa, Homo sapiens
MPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMGRWSGGCDVGI

SEQ ID NO: 1031639 - protein, 369 aa, Homo sapiens
MPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMEEGHFDADGNYFLNRDAQIRDSWLDNIDWVKIRERPPGQRQASDSEEEDSLGQTSMSAQALLEGLLELLLPRETVAGALRRLGARGGGKGRKGPGQPSSPQRLDRLSGLADQMVARGNLGVYQETRERLAMRLKGLGCQTLGPHNPTPPPSLDMFAEELAEEELETPTPTQRGEAESRGDGLVDVMWEYKWENTGDAELYGPFTSAQMQVSCFLPPPALSLLPPLLSVVPQLCPLLQTWVSEGYFPDGVYCRKLDPPGGQFYNSKRIDFDLYT

SEQ ID NO: 1031640 - protein, 110 aa, Homo sapiens
MVLKPKSVKKPTPPPSLDMFAEELAEEELETPTPTQRGEAESRGDGLVDVMWEYKWENTGDAELYGPFTSAQMQTWVSEGYFPDGVYCRKLDPPGGQFYNSKRIDFDLYT

SEQ ID NO: 1031641 - protein, 341 aa, Homo sapiens; identical to SEQ ID NO: 1031636

SEQ ID NO: 1031642 - protein, 341 aa, Homo sapiens; identical to SEQ ID NO: 1031636

SEQ ID NO: 1031643 - protein, 231 aa, Homo sapiens
MPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMEEGHFDADGNYFLNRDAQIRDSWLDNIDWVKIRERPPGQRQASDSEEEDSLGQTSMSAQALLEGLLELLLPRETVAGALRRLGARGGGKGRKGPGQPSSPQRLDRLSGLADQMVARGNPGGQFYNSKRIDFDLYT

SEQ ID NO: 1031644 - protein, 99 aa, Homo sapiens
SGIDIDFFTGLFLQLPHHQNHHQHQDQKDKNPSRNRKKLLKHQKGPSSVEDIKAKMQASIEKGGSLPKVEAKFINYVKNCFRMTDQEAIQDLWQWRKSL

SEQ ID NO: 1031645 - protein, 124 aa, Homo sapiens
PWCDSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLNNVCTANGFPWGL

SEQ ID NO: 1031646 - protein, 124 aa, Homo sapiens; identical to SEQ ID NO: 1031645

SEQ ID NO: 1031647 - protein, 124 aa, Homo sapiens; identical to SEQ ID NO: 1031645

SEQ ID NO: 1031648 - protein, 124 aa, Homo sapiens; identical to SEQ ID NO: 1031645

SEQ ID NO: 1031649 - protein, 112 aa, Homo sapiens
VRVIRGSRCRYYYLSACRHPMEDSMDMDMSPLRPQNYLFGCELKADKDYHFKVDNDENEHQLSLRTVSLGAGAKDELHIVEAEAMNYEGSPIKVTLATLNNVCTANGFPWGL

SEQ ID NO: 1031650 - protein, 124 aa, Homo sapiens; identical to SEQ ID NO: 1031645

SEQ ID NO: 1031651 - protein, 124 aa, Homo sapiens; identical to SEQ ID NO: 1031645

SEQ ID NO: 1031652 - protein, 124 aa, Homo sapiens; identical to SEQ ID NO: 1031645

SEQ ID NO: 1031653 - protein, 99 aa, Homo sapiens; identical to SEQ ID NO: 1031644

SEQ ID NO: 1031654 - protein, 124 aa, Homo sapiens; identical to SEQ ID NO: 1031645

SEQ ID NO: 1031655 - protein, 145 aa, Homo sapiens
PWCDSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLNNVCTAKFINYVKNCFRMTDQEAIQDLWQWRKSL

SEQ ID NO: 1031656 - protein, 70 aa, Homo sapiens
VRNSTLQGKTELRDAGGQNQLSREAEEKSCLQKGGSLPKVEAKFINYVKNCFRMTDQEAIQDLWQWRKSL

SEQ ID NO: 1031657 - protein, 124 aa, Homo sapiens; identical to SEQ ID NO: 1031645

SEQ ID NO: 1031658 - protein, 124 aa, Homo sapiens; identical to SEQ ID NO: 1031645

SEQ ID NO: 1031659 - protein, 124 aa, Homo sapiens; identical to SEQ ID NO: 1031645

SEQ ID NO: 1031660 - protein, 124 aa, Homo sapiens; identical to SEQ ID NO: 1031645

SEQ ID NO: 1031661 - protein, 124 aa, Homo sapiens; identical to SEQ ID NO: 1031645

SEQ ID NO: 1031662 - protein, 124 aa, Homo sapiens; identical to SEQ ID NO: 1031645

SEQ ID NO: 1031663 - protein, 180 aa, Homo sapiens
MDMDMSPLRPQNYLFGCELKADKDYHFNGCAATFNQPLAEPPSGPTNPTPPLGQRPTQTPSLHATPQYARLVQRMSCTLLTRGPPYWPMNYEGSPIKVTLATLNNVCTCPPGGLPQPTVSLGGFEITPPVVLRLKCGSGPVHISGQHLVAVEEDAESEDERGGGCETLKYIWKAVCPWRW

SEQ ID NO: 1031664 - protein, 124 aa, Homo sapiens; identical to SEQ ID NO: 1031645

SEQ ID NO: 1031665 - protein, 119 aa, Homo sapiens
MHALVLIAYHVRRCDCLHTHECERFGWDNGAVERTHDGPLGKLSCVGCELKADKDYHFKVDNDENEHQLSLRTVSLGAGAKDELHIVEAEAMNYEGSPIKVTLATLNNVCTANGFPWGL

SEQ ID NO: 1031666 - protein, 124 aa, Homo sapiens; identical to SEQ ID NO: 1031645

SEQ ID NO: 1031667 - protein, 78 aa, Homo sapiens
WATSPKSGCRSFCLRQKLLHHQKGPSSVEDIKAKMQASIEKGGSLPKVEAKFINYVKNCFRMTDQEAIQDLWQWRKSL

SEQ ID NO: 1031668 - protein, 124 aa, Homo sapiens; identical to SEQ ID NO: 1031645

SEQ ID NO: 1031669 - protein, 124 aa, Homo sapiens; identical to SEQ ID NO: 1031645

SEQ ID NO: 1031670 - protein, 124 aa, Homo sapiens; identical to SEQ ID NO: 1031645

SEQ ID NO: 1031671 - protein, 124 aa, Homo sapiens; identical to SEQ ID NO: 1031645

SEQ ID NO: 1031672 - protein, 124 aa, Homo sapiens; identical to SEQ ID NO: 1031645

SEQ ID NO: 1031673 - protein, 124 aa, Homo sapiens; identical to SEQ ID NO: 1031645

SEQ ID NO: 1031674 - protein, 124 aa, Homo sapiens; identical to SEQ ID NO: 1031645

SEQ ID NO: 1031675 - protein, 101 aa, Homo sapiens
GPCVYRPRFFSVSFITSSVYRSLAGGGMRLPRGTQVSLHLALYPVSFAVFMCSDALPLGASKLQCPLPPGRGDPQAPSAQRCTCLVALLLPGTVDLSVCLF

SEQ ID NO: 1031676 - protein, 1737 aa, Homo sapiens
SPLRAPAGREGGAPAEVAAAPQDGSSCSLVSRQLTDHSQLLQATCIPCLRASLLHPPSQQLWDGRRSCPCSHWVKEAETTDMTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSGAQVDTRFPSEPRILCNCALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELLYPQLFVVLLLRVSCTVGVQLPRNLQAQERRGASPALATRNLEPCSSAVDTLRSMLLRSGSEDVVQRMDLEGGWELLRTSAGHEEGATRLASGPLSQAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 1031677 - protein, 607 aa, Homo sapiens
MAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYLYPQLFVVLLLRVSCTVGVQLPRNLQAQERRGASPALATRNLEPCSSAVDTLRSMLLRSGSEDVVQRMDLEGGWELLRTSAGHEEGATRLASGPLSQAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 1031678 - protein, 1720 aa, Homo sapiens
SPLRAPAGREGGAPAEVAAAPQDGSSCSLVSRQLTDHSQLLQATCIPCLRASLLHPPSQQLWDGRRSCPCSHWVKEAETTDMTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYLYPQLFVVLLLRVSCTVGVQLPRNLQAQERRGASPALATRNLEPCSSAVDTLRSMLLRSGSEDVVQRMDLEGGWELLRTSAGHEEGATRLASGPLSQAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 1031679 - protein, 1715 aa, Homo sapiens
SPLRAPAGREGGAPAEVAAAPQDGSSCSLVSRQLTDHSQLLQATCIPCLRASLLHPPSQQLWDGRRSCPCSHWVKEAETTDMTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYLYPQLFVVLLLRVSCTVGVQLPRNLQAQERRGASPALATRNLEPCSSAVDTLRSMLLRSGSEDVVQRMDLEGGWELLRTSAGHEEGATRLASGPLSQAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGKHHPLPHPHAARQPRLMPPLHRVPGAALGAQAAAAGGPGPAHCG

SEQ ID NO: 1031680 - protein, 590 aa, Homo sapiens
SPLRAPAGREGGAPAEVAAAPQDGSSCSLVSRQLTDHSQLLQATCIPCLRASLLHPPSQQLWDGRRSCPCSHWVKEAETTDMTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAVISENILMLVLQCPAVGTEPCSSPRPFCSHQQPGPSSHQGPLLGHTRLPDVGGSSSLESSFCGSHIASSLPLSLSFRGTFQNKPWVLTPFFQCSTPMNMFLSLSSAPLLMLPQCVVILFTVQLSLCLFH

SEQ ID NO: 1031681 - protein, 99 aa, Homo sapiens
SPLRAPAGREGGAPAEVAAAPQDGSSCSLVSRQLTDHSQLLQATCIPCLRASLLHPPSQQLWDGRRSCPCSHWVKEAETTDMTESSMKSECMGIGSGRV

SEQ ID NO: 1031682 - protein, 1640 aa, Homo sapiens
QDFHEAPNPSYYCFSSKRPCHAFLQMSCVAVFTEPEHFSYVGPPPPAVAAIAVRVDELAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYLYPQLFVVLLLRVSCTVGVQLPRNLQAQERRGASPALATRNLEPCSSAVDTLRSMLLRSGSEDVVQRMDLEGGWELLRTSAGHEEGATRLASGPLSQAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 1031683 - protein, 1054 aa, Homo sapiens
MCPGSSQPCEGSGSQPLSGIFGLQFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYLYPQLFVVLLLRVSCTVGVQLPRNLQAQERRGASPALATRNLEPCSSAVDTLRSMLLRSGSEDVVQRMDLEGGWELLRTSAGHEEGATRLASGPLSQAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGFLVLHSEPRQQPQVDLDQLIAALQILLKDPAPEVRTRAAEALGRLVKLA

SEQ ID NO: 1031684 - protein, 1688 aa, Homo sapiens
SPLRAPAGREGGAPAEVAAAPQDGSSCSLVSRQLTDHSQLLQATCIPCLRASLLHPPSQQLWDGRRSCPCSHWVKEAETTDMTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDSHTCMLWRALAVEPRLAAQVLGLLLEKMSRDVPFKESRAFLLGRTPDRVATLLPLSATCALFEVMSTPAAGPAVLELYLYPQLFVVLLLRVSCTVGVQLPRNLQAQERRGASPALATRNLEPCSSAVDTLRSMLLRSGSEDVVQRMDLEGGWELLRTSAGHEEGATRLASGPLSQAMAEHAGPRLPLVLKTLACTHSSAYENQRVTTTAFLAELLNSNVANDLMLLDSLLESLAARQKDTCASVRRLVLRGLANLASGCPDKVRTHGPQLLTAMIGGLDDGDNPHSPVALEAMLGLARLVHLVESWDLRSGLLHVAIRIRPFFDSEKMEFRTASIRLFGHLNKVCHGDCEDVFLDQVVGGLAPLLLHLQDPQATVASACRFALRMCGPNLACEELSAAFQKHLQEGRALHFGEFLNTTCKHLMHHFPDLLGRLLTTCLFYFKSSWENVRAAAPLFTGSSRRWTWTSSLRRSRSC

SEQ ID NO: 1031685 - protein, 179 aa, Homo sapiens [sequence omitted]

SEQ ID NO: 1031686 - protein, 1449 aa, Homo sapiens
MTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAAAQMEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDEHTEETLPQEEWEEKLLMFLRDTLAIISDNAWICQLSLELCRQLPCYDEAPQEKNFLYKCIGTTLGAASSKEVVRKHLQELLETARYQEEAEREGLACCFGICAISHLEDTLAQLEDFVRSEVFRKSIGILNIFKDRSENEVEKVKSALILCYGHVAARAPRELVLAKVESDILRNICQHFSTKDPALKLCLVQSVCMVSRAICSSTQAGSFHFTRKAELVAQMMEFIRAEPPDSLRTPIRKKAMLTCTYLVSVEPALDEQARADVIHGCLHSIMALLPEPKEEDGGCQKSLYLETLHALEDLLTSLLQRNMTPQGLQIMIEHLSPWIKSPRGHERARALGLSALLLRYFLEHLRVSALVPFHNLGLLIGLFSPRCADLWPATRQEAVDCVYSLLYLQLGYEGFSRDYRDDVAERLLSLKDGLVHPDPAILFHTCHSVGQIIAKRLPPDQLISLLLTMFEALGDPEKNCSRAATVMINCLLQERGGVLQEKVPEIVSVLRSKLQEAQGEHVLPAAQHSVYLLATQHCAAVVSSLLGSPLPLDRYPAQTPGLGVPLEDAPPGMMLPEPSTRLCTPTFCMSSHGCRPRGTESDMELGPSLSGTHGDLSSPGVLGSSLAPGALHSTPTGKLLFLPSSKVPKLPGCSVGPRLQHTLEAAPHPVSWFRLLQALSSAGHPLLPVSRPLGTAWSEPPQEPKDNLVCTIHHYVFPSSHLPAPSKGQGVSTTHQPTGVPLPRRGLRSMGLLALPFFAILVMDRGWPRGTWLPVTSGRLHAGQGRVTLPLAGGGMRLPRGTQVSLHLALYPVSFAVFMCSDALPLGASKLQCPLPPGRGDPQAPSAQRCTCLVALLLPGTVDLSVCLF

SEQ ID NO: 1031687 - protein, 1720 aa, Homo sapiens; identical to SEQ ID NO: 1031678

SEQ ID NO: 1031688 - protein, 71 aa, Homo sapiens
MSDEEVEQVEEQYEEEEEAQEEAAEVHEEVHEPEEVQEEEKPRPKLTAPKIPEGEKVDFDDIHKKRENKDL

SEQ ID NO: 1031689 - protein, 60 aa, Homo sapiens
MSDEEVEQVEEQYEEEEEAQEEEEVQEEEKPRPKLTAPKIPEGEKVDFDDIHKKRENKDL

SEQ ID NO: 1031690 - protein, 99 aa, Homo sapiens
GCPQGAPALLTLDPQKPPTFTMSDEEVEQVEEQYEEEEEAQEEAAEVHEEVHEPEEVQEDTAEEDARGSQEEEKPRPKLTAPKIPEGEKVDFDDIHKKR

SEQ ID NO: 1031691 - protein, 109 aa, Homo sapiens
MLLTCNFSPNSVLTETCAVLNQRLMHLGPCRMCFVNNVFAGSMLGKSHPHPPFLINQGHSALQKAAGTSAQESLGIVQGFPPLRQPEIWPRGKGKILPSPSPTPVKGLC

SEQ ID NO: 1031692 - protein, 109 aa, Homo sapiens; identical to SEQ ID NO: 1031691

SEQ ID NO: 1031693 - protein, 106 aa, Homo sapiens
AGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 1031694 - protein, 104 aa, Homo sapiens
MDTYKQAEEPRSEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 1031695 - protein, 59 aa, Homo sapiens
MQGTTGREPFLSVFLSDERRGLGRRERAGAGRLLHDLDVSVWLRQFHDAHSYVNCWIAA

SEQ ID NO: 1031696 - protein, 165 aa, Homo sapiens
MQDLKKYKKKKQKRMKSRKVRKPTENQEKNIRKRERRKNPKGENVRNIREDGELEDGEIDDAGFEEIQEKEAKENEKQKSEKAYRKSRKKHKKEREKKNPKGENVRNIREDGELEDGEIDDAGFEEIQEKEAKENEKQKSEKAYRKSRKKHKKEREKKKSQKAKT

SEQ ID NO: 1031697 - protein, 340 aa, Homo sapiens
KLRGNGSGHIGSSVGGAKFDLHHANAGTNVKHKRGDDDDEDTERELREKAFLIPLDASPGIMLQDPRSQLRQFSHIKMDITLTKPNFAKHIVWAPEDLLPVPLPKPDPVSSINLPLPPLIADQRLNRLWNTKSDLHQNTVSIDPKLAAKAKINTTNREGYLEQFGDSHGSGAKLGDPRLQKNFDPRLHRLPNTESHQVVMKDSHASKGAPHLPRSNPGSSQPSGAGTSNSGSGALPPYAPKLSSSAGLPLGTSTSVLSGISLYDPRDHGSSSTSELATASSGENSKNQKKSGGLKSSDKTEPSPGEAILPQKPSPNVGVTLEGPADPQADVPRSSEKMAN

SEQ ID NO: 1031698 - protein, 344 aa, Homo sapiens
KLRGNGSGHIGSSVGGAKFDLHHANAGTNVKHKRGDDDDEDTERELREKAFLIPLDASPGIMLQDPRSQLRQFSHIKMDITLTKPNFAKHIVWAPEDLLPVPLPKPDPVSSINLPLPPLIADQRLNRLWNTKSDLHQNTVSIDPKLAAKAKINTTNREGYLEQFGDSHGSGAKLGDPRLQKNFDPRLHRLPNTESHQVVMKDSHASKGAPHLPRSNPGSSQPSGAGTSNSGSGALPPYAPKLSSSAGLPLGTSTSVLSGISLYDPRDHGSSSTSELATASSGENSKNQKKSGGLKSSDKTEPSPGEAILPQKPSPNVGVTLEGPADPQADVPRSSGSVLKWGCG

SEQ ID NO: 1031699 - protein, 187 aa, Homo sapiens
MTDSEHAGHDREDGELEDGEIDDAGFEEIQEKEAKENEKQKSEKAYRKSRKKHKKEREKKKSKRENVRNIREDGELEDGEIDDAGFEEIQEKEAKENEKQKSEKAYRKSRKKHKKEREKKNPKGENVRNIREDGELEDGEIDDAGFEEIQEKEAKENEKQKSEKAYRKSRKKHKKEREKKKSQKAKT

SEQ ID NO: 1031700 - protein, 403 aa, Homo sapiens
KLRGNGSGHIGSSVGGAKFDLHHANAGTNVKHKRGDDDDEDTERELREKAFLIPLDASPGIMLQDPRSQLRQFSHIKMDITLTKPNFAKHIVWAPEDLLPVPLPKPDPVSSINLPLPPLIADQRLNRLWNTKSDLHQNTVSIDPKLAAKAKINTTNREGYLEQFGDSHGSGAKLGDPRLQKNFDPRLHRLPNTESHQVVMKDSHASKGAPHLPRSNPGSSQPSGAGTSNSGSGALPPYAPKLSSSAGLPLGTSTSVLSGISLYDPRDHGSSSTSELATASSGENSKNQKKSGGLKSSDKTEPSPGEAILPQKPSPNVGVTLEGPADPQADVPRSSGKVQVPAVHSLPVQALTGLIRPQYSDPRQARQPGQGSPTPDNDPGRETDDKSLKEVFKTFDPTASPFC

SEQ ID NO: 1031701 - protein, 80 aa, Homo sapiens
GTRQALDSYPGGEGSGPRRGGRAGLACPPRGVIDPKGVAFSLRAGLSLMADLGKEVWEGEFSLAPGGGWNLKEKTVWLLT

SEQ ID NO: 1031702 - protein, 668 aa, Homo sapiens
GTRQALDSYPGGEGSGPRRGGRAGLACPPRGVIDPKGVAFSLRAGLSLMADLGKEVWEGEFSLAPGGGWNLKEKTVWLLNKSLCPVSLSKGEGGQVLGRTPGPYSRRSYVCVSFVEVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQEQKVYVQHRLRELGSLVWELLDRQGAYFYLAGNAKSMPADVSEALMSIFQEEGGLCSPDAAAYLARLQQTRRFQTETWA

SEQ ID NO: 1031703 - protein, 606 aa, Homo sapiens
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQPPALFSALQEQKVYVQHRLRELGSLVWELLDRQGAYFYLAGNAKSMPADVSEALMSIFQEEGGLCSPDAAAYLARLQQTRRFQTETWA

SEQ ID NO: 1031704 - protein, 617 aa, Homo sapiens
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQRQVHASGRLGSPDVHLPGGGWTLQPGRSRVSSQAPADTALPDRDVGLRPAAARAPSDSHPPGSPGRHPRGSSWPAAVILSDQPAGPLGTASSRAQPHSC

SEQ ID NO: 1031705 - protein, 597 aa, Homo sapiens [sequence omitted]

SEQ ID NO: 1031706 - protein, 132 aa, Homo sapiens
SSLLSRPTRKMAPQKDRKPKRSTWRFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESESED

SEQ ID NO: 1031707 - protein, 132 aa, Homo sapiens; identical to SEQ ID NO: 1031706

SEQ ID NO: 1031708 - protein, 142 aa, Homo sapiens
GQKHNQDARILNCFSRLPGSCHEQKDRKPKRSTWRFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESESED

SEQ ID NO: 1031709 - protein, 132 aa, Homo sapiens; identical to SEQ ID NO: 1031706

SEQ ID NO: 1031710 - protein, 132 aa, Homo sapiens; identical to SEQ ID NO: 1031706

SEQ ID NO: 1031711 - protein, 132 aa, Homo sapiens; identical to SEQ ID NO: 1031706

SEQ ID NO: 1031712 - protein, 202 aa, Homo sapiens
GSLFPDLVRAGGAIMGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 1031713 - protein, 225 aa, Homo sapiens
MSSRYGDPLWCLPPMKNTGRVTEIRKYSPGNARSIIHCQYCFVWVKDHSIDYTSDASEGILRHLWFPVVMTMSGVAFGQYTYHFRSVTGGMYSASNKNCNGVGRRPGRSASRLMSCMPYITGSMGKHGVNPMLKVCALRVTSRARSRILRAGGKILTFDQLALDSPKGCGTVLLSGPRKGREVYRHFGKAPGTPHSHTKPYVRSKGRKSEVAFPKGLTGQRGYKN

SEQ ID NO: 1031714 - protein, 120 aa, Homo sapiens
GSLFPDLVRAGGAIMGVDIRHNKDRKVRRKEPKSQDIYLRLLVKLYRFLARRTNSTFNQVVLKRLFMSRTNRPPLSLSRMIRKMKLPEGMCTARDQPGPQPHPQGRGQDPHFRPAGPGLP

SEQ ID NO: 1031715 - protein, 188 aa, Homo sapiens [sequence omitted]

SEQ ID NO: 1031716 - protein, 82 aa, Homo sapiens
HPTYTSCDVQSYRGIVKCSSLDDSSARDLERSHRQLLTPRLLTFVSRLRRVSHSQPDRRTQPTSLKEFERARGRRASRGYKN

SEQ ID NO: 1031717 - protein, 202 aa, Homo sapiens; identical to SEQ ID NO: 1031712

SEQ ID NO: 1031718 - protein, 115 aa, Homo sapiens
GSLFPDLVRAGGAIMGVDIRHNKDRKVRRKEPKSQDIYLRLLVKLYRFLARRTNSTFNQVVLKRLFMSRTNRPPLSLSRMIRKMKLLPEQEAVFWAIYDVGSEAQLRFSLGTPPS

SEQ ID NO: 1031719 - protein, 253 aa, Homo sapiens
VPGGNGTWTPGGLEARCCSLSLRFLALLGHPNLAAARLRRIPGDSLDLDPQICPTPQADRAGGAIMGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 1031720 - protein, 202 aa, Homo sapiens; identical to SEQ ID NO: 1031712

SEQ ID NO: 1031721 - protein, 211 aa, Homo sapiens
GSLFPDLVRAGGAIMGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGRELRFAASTHSASPGTRTAHNYSSGECSCRTAAQYKLLIYLYKLSNKKCRRD

SEQ ID NO: 1031722 - protein, 240 aa, Homo sapiens
ERTRRSSPAVTGAERICGLGLRGSGCGLLGLRGAELGSGAQAVPRGAMKGKEEKEGGARLGAGGGSPEKSPELRRSSRSRAIVLFVGLKVPWSAGWPATCRAITRNPLVAVYYTNLGLVLPEDAAARAGPGRLPGCALELDGQSVKAHFFLGQCQLEMESYDEAIANLQRAYSLAKEQRLNFGDDIPSALRIAKKKRWNSIEERRIHQESELHSYLSRLIAAERDKGSWKTVPANTTEGY

SEQ ID NO: 1031723 - protein, 262 aa, Homo sapiens
MRPGVLRGARVLRVCSVSAVAACVPADGCCDACVMLCCPCACACCCAAMNVCNGCDEVMCAVCTGFGAGIGGGSPEKSPELRRSSRSRAIVLFVGLKVPWSAAGLLRAARSPWNPLVAVYYTNLGLVLPEDAAARAGPGRLPGCALELDGQSVKAHFFLGQCQLEMESYDEAIANLQRAYSLAKEQRLNFGDDIPSALRIAKKKRWNSIEERRIHQESELHSYLSRLIAAERDKGSWKTVPANTTEGYEVRQAGFVAMSGLD

SEQ ID NO: 1031724 - protein, 111 aa, Homo sapiens
AAPEALLSPRPRPPTFCTVAELEVSGLRGHAGLGFSRGSEVGNKEGKKEEKQAGEGRKRTARRPRRREPQNFQFYPEAFFVVFFSSDMILSEVGPGLPYVIHGRGLSPKSP

SEQ ID NO: 1031725 - protein, 116 aa, Homo sapiens
GRPRSAAVTPAAPPNFLHSRGAGSFRASRTRWAGFQSRLRGWQQRGKEGGKAGRGGEEENRAEAAAPRAPELPILPRSFFRRVFLLGKQASSTPQSCWGLRQPPLWAHLPAPPRGT

SEQ ID NO: 1031726 - protein, 116 aa, Homo sapiens; identical to SEQ ID NO: 1031725

SEQ ID NO: 1031727 - protein, 116 aa, Homo sapiens; identical to SEQ ID NO: 1031725

SEQ ID NO: 1031728 - protein, 189 aa, Homo sapiens
MARGAALAHGALRACWVYWSAAAGMVGFDLSDALPDNENKKPTAIPKKPSAGDDFDLGDAVVDGENDDPRPPNPPKPMPNPNPNHPSSSGSFSDADLADGVQVEKEKEAVMVEAATGKNGEEADAPGVIPEDCGGLSVVSRGMEPSSSFIAYQKKKLCFKENAEQGEVDMESHRNANAEPAVQRTLLEK

SEQ ID NO: 1031729 - protein, 147 aa, Homo sapiens
AQPALSLQWPLPSPAPFESPGFLPHPARGGVSVLPASPTPCLRDRPCALLGAPMARGAALAHGALRACWVYWSAAAGVVGSDLSDALPDNENKKPTAIPKKPSAGDDFDLGDAVVDGENDDDDDDDDDDDDDDDDDDDDDDDDDDDD

SEQ ID NO: 1031730 - protein, 510 aa, Homo sapiens
MWVMAHHGWKPSGTSETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTSQNQYVTSHHYKSYPQWYGPSPDCHKCHRILPQGSHHPMHSPILINVSPYHCAAKEISKPTLPRAHSPKSCKEPTQPGPKEVRMTTKSARRTSPGDRTIEQMNAKANTIKGDPRKQQ

SEQ ID NO: 1031731 - protein, 407 aa, Homo sapiens
MWVMAHHGWKPSGTSETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTCTSTSPASLSSPDGDYSMSTLLVMRA

SEQ ID NO: 1031732 - protein, 492 aa, Homo sapiens
MWVMAHHGWKPSGTSETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTKYYRMATIITPYSLHYSVITQTNEKEKKRRALISGGTRGSEVGHVIGVLTHFLAQVATCRPQWDREVDSRYRRAARDQQRSTQGGTSDNYTPHQPEHTTPHTQLSPHEHTRKR

SEQ ID NO: 1031733 - protein, 329 aa, Homo sapiens
SGSFWTGIQEEKGGVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTSQNQYVTSHHYKSYPQWYGPSPDCHKCHRILPQGSHHPMHSPILINVSPYHCAAKEISKPTLPRAHSPKSCKEPTQPGPKEVRMTTKSARRTSPGDRTIEQMNAKANTIKGDPRKQQ

SEQ ID NO: 1031734 - protein, 514 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 1031735 - protein, 514 aa, Homo sapiens; identical to SEQ ID NO: 1031734

SEQ ID NO: 1031736 - protein, 463 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGDRRNSSSQLETRNYQEKEILMNVEFFLSLFFSF

SEQ ID NO: 1031737 - protein, 139 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKYEIL

SEQ ID NO: 1031738 - protein, 505 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 1031739 - protein, 448 aa, Homo sapiens
MKRVTNEKWQSSFVMSMVLCCICLLQKKILKRRVLRMQRIHMFINSTLPIKDKKLNTLWQVHIHTHQDLADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 1031740 - protein, 280 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGINWLGWHIEWRGDIAKDPLSLGEHKEVDWIKVRIQDYGCSAKWE

SEQ ID NO: 1031741 - protein, 512 aa, Homo sapiens
MEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 1031742 - protein, 139 aa, Homo sapiens; identical to SEQ ID NO: 1031737

SEQ ID NO: 1031743 - protein, 448 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 1031744 - protein, 514 aa, Homo sapiens; identical to SEQ ID NO: 1031734

SEQ ID NO: 1031745 - protein, 514 aa, Homo sapiens; identical to SEQ ID NO: 1031734

SEQ ID NO: 1031746 - protein, 197 aa, Homo sapiens
IDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPETTGIQRYYDNEIPK

SEQ ID NO: 1031747 - protein, 142 aa, Homo sapiens
MVKVTGLKLSQDLDDLAILYLATVQAIALGTRFIIEAMEAAGHSISTLFLCGGLSKNPLFVQMHADITGMPVVLSQEVESVLVGAAVLGACASGDFASVQSDPRTGPVTFHPLSFHRPLEATQWLVAAILVQMRTLKLRNVV

SEQ ID NO: 1031748 - protein, 204 aa, Homo sapiens
IDHMVQGHAAFPELQVKATARCQSIYAYLNSHLDLIKKAQPVGFLTVDLHVWPDFHGTIWTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQSDPRTGPVTFHPLSFHRPLEATQWLVAAILVQMRTLKLRNVV

SEQ ID NO: 1031749 - protein, 165 aa, Homo sapiens
IDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGKQGKNEQSGKVVFPETTGIQRYYDNEIPK

SEQ ID NO: 1031750 - protein, 209 aa, Homo sapiens
IDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQSDPRTGPVTFHPLSFHRPLEATQWLVAAILVQMRTLKLRNVV

SEQ ID NO: 1031751 - protein, 156 aa, Homo sapiens
SRSEKRNIRVGVTLIFQVTGLKLSQDLDDLAILYLATVQAIALGTRFIIEAMEAAGHSISTLFLCGGLSKNPLFVQMHADITGMPVVLSQEVESVLVGAAVLGACASGDFASVQSDPRTGPVTFHPLSFHRPLEATQWLVAAILVQMRTLKLRNVV

SEQ ID NO: 1031752 - protein, 179 aa, Homo sapiens
MEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREGLGPFYERCHRVRVTPIASSTPPTLYLPHTDTHDYHSPYHPSRTIS

SEQ ID NO: 1031753 - protein, 2509 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1031754 - protein, 2509 aa, Homo sapiens; identical to SEQ ID NO: 1031753

SEQ ID NO: 1031755 - protein, 2509 aa, Homo sapiens; identical to SEQ ID NO: 1031753

SEQ ID NO: 1031756 - protein, 2509 aa, Homo sapiens; identical to SEQ ID NO: 1031753

SEQ ID NO: 1031757 - protein, 2478 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKACGWGPLSAGIWFSPLSGGSWATSPEEAGGL

SEQ ID NO: 1031758 - protein, 2335 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1031759 - protein, 359 aa, Homo sapiens
GCHSERSYPDSHLTEHRGDLRACLCVLAWVPGLCTQTSLASAPVFTELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1031760 - protein, 2151 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1031761 - protein, 159 aa, Homo sapiens
MEHNRVLEALLPLKGLEERVAAAVDLIIKSHQGLDRQELSFAARSFYYKLRAAEQYTPKAKYHGNVMLLRAKTGGAYGEDLGADYNLSQVRKGPDGNGDRDRSGVGRQLIASLQVCDGKVSVHVIEGDHRTLLEGSGLESIISIIHSSLAEPRVSVREG

SEQ ID NO: 1031762 - protein, 1347 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVVLLTASVHTCGAEDGFCLNMSGGPSGLCFT

SEQ ID NO: 1031763 - protein, 200 aa, Homo sapiens
SQMLTTESPRTNHQRELVADLNGVEPSTVTGRVLYIVYRYIIKARAVRVRMETKAICLLRAARFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1031764 - protein, 2509 aa, Homo sapiens; identical to SEQ ID NO: 1031753

SEQ ID NO: 1031765 - protein, 2509 aa, Homo sapiens; identical to SEQ ID NO: 1031753

SEQ ID NO: 1031766 - protein, 1077 aa, Homo sapiens
NEYYSAIPGVISYEGRRSLESLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1031767 - protein, 2334 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRGRCSPRAPTAWPATPTGPAWPLKCAPSCRPSRAQPPPTTASSCSTARPPTYWPTPRATGQS

SEQ ID NO: 1031768 - protein, 2159 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGEHSQEEPRQVFPLLASGSWDIAARS

SEQ ID NO: 1031769 - protein, 1452 aa, Homo sapiens
MEEVVIAGMFGKLPESENLQEFWDNLIGGVDMVTDDDRRWKAGLYGLPRRSGKLKDLSRFDASFFGVHPKQAHTMDPQLRLLLEATYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARKVYTTILNKGTNTDGFKEQGVTFPQDIQEQPIRSLYQSAGVAPESFEYIEAHGPGTKVGDPQERNGITRALCATRQEPLLIGSTKSNMGHPEPASGLDALAKVLLSLEHGLWAPNLHFHSPNPEIPALLDGRLQVVDQPLPVRGGNVGINSFGFGGSNMHIILRPNTQSAPAPAPHATLPRLLRASGRTPEAVQKLLEQGLRHSQGLAFLSMLNDIAAVPATAMPFRGYAVLGGETRWPRVQQVPAGERPLWFICSGMGTQWRGMGLSLMRLDRFRDSILRSDEAVNRFGLKVSQLLLSTDESTFDDIVHSFVSLTAIQIGLIDLLSCMGPEADGIVGHSLGEWLSVRDGCLSQEEAVLAAYWRGQCIKEAPLPAGAMAAVGLSWEECKQRCPPAVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPTPCPQAVLKRVRKPSCTIIPRMKKDHRDNLEFFLAGIGRLHLSGIDANPNALFPPVESPAPRGTPLISPLIKWDHSLAWDAPAAEDFPNGSGSPSATIYTCTPSSESPDRYLVDHTIDGRVLFPATGYLSIVWKTLARAWAGLEQLPVVFEDVVQHQATILPKTGTVSLEVRLLEATGAFEVSENGNLVVSGKVYQWDDPDPRLFDHPESPHPNSPRSPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWPRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKVKPWPTFRAHPTFQLGEGLTLPDPL

SEQ ID NO: 1031770 - protein, 439 aa, Homo sapiens
MSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 1031771 - protein, 78 aa, Homo sapiens
GKRVRVQDWGNGGFQRQQGSLESRIGGYRTGAPGGSYRDSYDSYATHKRVKARSGSRSSVPMAGVFKELWELRVNVNG

SEQ ID NO: 1031772 - protein, 78 aa, Homo sapiens; identical to SEQ ID NO: 1031771

SEQ ID NO: 1031773 - protein, 78 aa, Homo sapiens; identical to SEQ ID NO: 1031771

SEQ ID NO: 1031774 - protein, 813 aa, Homo sapiens
PSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKTFHSCPRPSGSRGGTEPSPRPCGSQEPSSEGRVIPVPFPGKIVPRDDEGRPLDPEDRAREQRRQLQKQERLEWQDPELMRDVEAATGQDLGSSRYSGKGRGKKRRYPSLTNLKAQADTARARIGRKSLRQVRVAAGSPPTAWPPRVRVFEGGHLSAKIFQGLGASRGSPALSSPGGPPSLSPGRGSASQQGQQAGLLRNAPQHSPGEEGLDRQAPPSSLPGGAMPGHRPWLVQSEPLVSPLPGCTPRSVPAYFCSGDFREGDDCKGGQNGGPRVSPSRAQPQHVFSEHWLWEAGLVSLQPSMGLVTGEDLAGPECEAHQPGVPACSLSAGAPATRTALCFCLHIALFSPKKIQNAVFRSHLRLLTPSQICVKSLLVQVCLVAPVRWPPPIAIPETLPWTHLEGAKCTGQRRPLLASMTVHRPEWARVGGAFTALRPGFPQACGWYIHSLAVGGAGALVGAVERLPGAPGTGLDPSRMPATQGTLALGAQGEAVFPVDQPGAEASLGADAQEEEWPVGPCQASSLCLMGTLKPMAGAGSSPQLCGPDPSLQKGSGVTTGKTLPRGAPTAAPGSPTGAAAERQLHHIVASGPAGSTAPHPRGSQQLSWSAQHTSSCSPECLPGPCPPCCSPPGFQPWPWSRACSSGQGCPDASWLHLLRGRSPGGQGGGCPHPGVREATGEVPRWGWGHLHRAEPPAADSASGTWGGPF

SEQ ID NO: 1031775 - protein, 241 aa, Homo sapiens
KDTGDLKDSSLLKPYRKHKKQHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 1031776 - protein, 223 aa, Homo sapiens
KDTGDLKDSSLLKPYRKHKKQHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLIDSFLFF

SEQ ID NO: 1031777 - protein, 241 aa, Homo sapiens; identical to SEQ ID NO: 1031775

SEQ ID NO: 1031778 - protein, 284 aa, Homo sapiens
MAVGENDERLEGVQAAAALAVRFQDPALVAGALHAELVLVALLAAFEMLGTVALDLAGVVVGPQLPCPEGRNTQCLRQVPLSSLAAATVIQRALVQSSPSSEPSPQSSCAYPTCFPLTQFTCNNGRCININWRCDNDNDCGDNSDEAGCSHSCSSTQFKCNSGRCIPEHWTCDGDNDCGDYSDETHANCTNQGGHQGPVGVGMRSSPLHQTPSLSICLSDPRCVGHHLGARGSLGMALVLQELPVLWEREVAEKSLPHAVNIMRFAVGGLGFELQLCSLLSGWP

SEQ ID NO: 1031779 - protein, 222 aa, Homo sapiens
DESMPLVQPAPAPPTSAPVPVACCIPIFWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQGGHQGPVGVGMRSSPLHQTPSLSICLSDPRCVGHHLGARGSLGMALVLQELPVLWEREVAEKSLPHAVNIMRFAVGGLGFELQLCSLLSGWP

SEQ ID NO: 1031780 - protein, 139 aa, Homo sapiens
MAVGENDERLEGVQAAAALAVRFQDPALVAGALHAELVLVALLAAFEMLGTVALDLAGVVVGPQLPCPEGRNTQCLRQVPLSSCGCSHRYSESTGRRARPHLSRRHSRRCHHTACQGAGRLRCCWHKGARAAGPGLAVL

SEQ ID NO: 1031781 - protein, 301 aa, Homo sapiens
MAVGENDERLEGVQAAAALAVRFQDPALVAGALHAELVLVALLAAFEMLGTVALDLAGVVVGPQLPCPEGRNTQCLRQVPLSSLAAATVIQRALVQSSPSSEPSPQSSCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDWMDSSDEKSCEGVTHVCDPSVKFGCKDSARCISKAWVCDGDNDCEDNSDEENCESLACRPPSHPCANNTSVCLPPD

SEQ ID NO: 1031782 - protein, 214 aa, Homo sapiens
KTPERVMRLTDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDWMDSSDEKSCEGVTHVCDPSVKFGCKDSARCISKAWVCDGDNDCEDNSDEENCESLACRPPSHPCANNTSVCLPPD

SEQ ID NO: 1031783 - protein, 69 aa, Homo sapiens
EPAKITQELVPPDGPKKEPMKEKQKQTAGLAHLPTPVGQGSASGNGSCPGNEQRFTRQHFDSMLSLFLY

SEQ ID NO: 1031784 - protein, 69 aa, Homo sapiens; identical to SEQ ID NO: 1031783

SEQ ID NO: 1031785 - protein, 147 aa, Homo sapiens
PAHAARSLSEAAVRVAAGARWGMAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQAFLFYQFNLLVTVKNVRKDWMR

SEQ ID NO: 1031786 - protein, 746 aa, Homo sapiens
MAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDLLQNPLLVPVKVLKGHVLTRDLGVLDVIFHPTQPWVFSSGADGTVRLFT

SEQ ID NO: 1031787 - protein, 442 aa, Homo sapiens
PAHAARSLSEAAVRVAAGARWGMAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRSTGATVTLSGASVSLLGASGWFQALTTAPCGSGRWPLPAV

SEQ ID NO: 1031788 - protein, 773 aa, Homo sapiens
PAHAARSLSEAAVRVAAGARWGMAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDHILKTHKMNKNNPKEKYWTSSSTPPSRGSSPRGQTGLSASSPSCSACLGLGWSC

SEQ ID NO: 1031789 - protein, 489 aa, Homo sapiens
PAHAARSLSEAAVRVAAGARWGMAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWLGWSC

SEQ ID NO: 1031790 - protein, 198 aa, Homo sapiens
CTLQVRGVTGRAVHPAGESGNTCITAFGPGDNVICGSYDSKLVWFDLDLSTKPYRMLRRGKLGVEAASRAPPFSPSLPSTWFPPPRHHKKALRAVAFHPRYPLFASGSDDGSVIVCHGMVYKWVLTLPGPLPRAVVSGRALSPPRPHSDLLQNPLLVPVKVLKGHVLTRDLGVLDVIFHPTQPWVFSSGADGTVRLFT

SEQ ID NO: 1031791 - protein, 791 aa, Homo sapiens
PAHAARSLSEAAVRVAAGARWGMAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVCGGGTPGGGTGGKADLALLLPRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDLLQNPLLVPVKVLKGHVLTRDLGVLDVIFHPTQPWVFSSGADGTVRLFT

SEQ ID NO: 1031792 - protein, 698 aa, Homo sapiens
LLRTRPGRCRKRLCGWRPARGGAWRVRGVRGARRRRACGRRSGGLSPNWSLSPSRSSTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDLLQNPLLVPVKVLKGHVLTRDLGVLDVIFHPTQPWVFSSGADGTVRLFT

SEQ ID NO: 1031793 - protein, 468 aa, Homo sapiens
PAHAARSLSEAAVRVAAGARWGMAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSSPSCSACLGLGWSC

SEQ ID NO: 1031794 - protein, 746 aa, Homo sapiens; identical to SEQ ID NO: 1031786

SEQ ID NO: 1031795 - protein, 190 aa, Homo sapiens
MDAASEFFRSGKYDLDFKSPDDPSRYISPDQLADLYKSFIKDYPVVSIEDPFDQDNWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1031796 - protein, 366 aa, Homo sapiens
VVCCRLVLGLGGASLSVLFAPGSCASCLSVCAAVGVFVESLCFVVLLVLSAVGLLVVGSVGGRRVAGVSFPVCLACDFLVLALVWSVWLYGLPVAFGCVMGVSVGSSVVLSRYFVILVCEVAVVCVGSPLCAPSLNVGVRVSRAYGPGILVSNGRQMCFMSLCCYVSCYCLECHSMRIMPCIRRRLFGSGWLLCCSFGDVACLCVTVASSHLAILAYVVFGFRYGPRYDGAVMDLDSDKSSLVLWSGGAFSDGLDEVSPVMGFMGLGCYYTDRHPIAFRPRVLASPSVTCWLHRPLPLCQLRQLEAPDQHLQGSLLVSAPPPWSSYRFLRTSTEAKLPGALLAALALQSCNWPKSLFFSPHFPPSV

SEQ ID NO: 1031797 - protein, 190 aa, Homo sapiens; identical to SEQ ID NO: 1031795

SEQ ID NO: 1031798 - protein, 67 aa, Homo sapiens
MIIPVRCFTCGKIVGNKWEAYLGLLQAEYTEGDALDALGLKRYCCRRMLLAHVDLIEKLLNYAPLEK

SEQ ID NO: 1031799 - protein, 67 aa, Homo sapiens; identical to SEQ ID NO: 1031798

SEQ ID NO: 1031800 - protein, 67 aa, Homo sapiens; identical to SEQ ID NO: 1031798

SEQ ID NO: 1031801 - protein, 67 aa, Homo sapiens; identical to SEQ ID NO: 1031798

SEQ ID NO: 1031802 - protein, 245 aa, Homo sapiens
MAGLELLSDQGYRVDGRRAGELRKIQARMGVFAQADGSAYIEQGNTKALAVVYGPHEIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVREASILLGD

SEQ ID NO: 1031803 - protein, 52 aa, Homo sapiens
MGVFAQADGSAYIEQGNTKALAVVYGPHELTALAYIEQGNTKALAVVYGPAR

SEQ ID NO: 1031804 - protein, 147 aa, Homo sapiens
MGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVREASILLGD

SEQ ID NO: 1031805 - protein, 245 aa, Homo sapiens; identical to SEQ ID NO: 1031802

SEQ ID NO: 1031806 - protein, 147 aa, Homo sapiens; identical to SEQ ID NO: 1031804

SEQ ID NO: 1031807 - protein, 152 aa, Homo sapiens
YYQADDANVVTDRDLEVDTTLKSLSQQIENIRSPERSRKNPARTCRDLKMCHSDWKSGEYWIDPNQGLPASLESNVFCNMETGETCVYPTQPSVAQKNWYISKNPKDKRHVWFGENMTDGFQFDYGGQGSDPAEDGIQLTFLRTDVHRGLPE

SEQ ID NO: 1031808 - protein, 329 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 1031809 - protein, 170 aa, Homo sapiens
MHPGPSSGGTEGGVPTALRPPGPLVPSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 1031810 - protein, 224 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTPPHHPPYLLNFVLDWPGPAQLSVISLFHIIYYFNFLLNY

SEQ ID NO: 1031811 - protein, 158 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQVRAFGVPMPMFLGRAAQAGY

SEQ ID NO: 1031812 - protein, 456 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYKELAESSPLRSVLLLSSILQMRRSGHQEVKYLPSVTQLKNGDTRTPGEVAWLPVPHWSCCAVLCWDLLSACGFPSETRLAWPQGWRRLSVEHQSPGQEQRTGNASRPVFWGYRGRGANCAEASWSPVPSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 1031813 - protein, 401 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQSRAYSGFSSCSRNVFLQLVHQTRVQSQIFTLHLVICKLTMESMTLRIVSCNNVEEMIRVIGILWHECDVLVQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 1031814 - protein, 195 aa, Homo sapiens
NLLRTELLFVTAIFAVPRTIPGAVHSLSICQMKKYTKRLGREGDEGEKTNNSACLTSELSLEDMTLLSKGVAERPGQAQGPDCRARRCVGAGALGRGMALRDCTRRKELGPAGKQTKVEFPEARIFEETLNILIYETPRGPDPALLEATGGAAGAGGAGRGEDEENREHRVRRIHVRRHITHDERPHGQQIVFKD

SEQ ID NO: 1031815 - protein, 329 aa, Homo sapiens [sequence omitted]

SEQ ID NO: 1031816 - protein, 329 aa, Homo sapiens [sequence omitted]

SEQ ID NO: 1031817 - protein, 528 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQSRAYSGFSSCSRNVFLQLVHQTRVQSQIFTLHLVICKLTMESMTLRIVSCNNVEEMIRVIGILWHECDVLVQQKRETLSPLCLIPMVTSPREEQQLLASTSKPVVKLLHNRSNNKYSYKELAESSPSEVSTVVSSILQMRRSGHQEVKYLPSVTQLKNGDTRTPGEVAWLPVPHWSCCAVLCWDLLSACGFPSETRLAWPQGWRRLSVEHQSPGQEQRTGNASRPVFWGYRGRGANCAEASWSPVPSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 1031818 - protein, 178 aa, Homo sapiens
MVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 1031819 - protein, 262 aa, Homo sapiens
PLWTEPPLSCCLPATYPADMGTAGAMQLCWVILGFLLFRESQVWGWGTRLLWKLQVKLRGGIFTGRDFSQPPYPLFPGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKCRKSKESEDPQKPGSSGLSESCSTANGEKDSITLISMKNINMNNGKQSLSAEKVL

SEQ ID NO: 1031820 - protein, 271 aa, Homo sapiens
PLWTEPPLSCCLPATYPADMGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGESGRRRWDIGGNPTPGIDLDSGSGNASSNLTHLFQEVLADEEDPCGRGAPALQLALLGCAGFHVLMQGWSRVESPLWLGGGRLRAHLFSREVELTLLLEPAYHSTYLGRECRTLVGPFVPPTGPLR

SEQ ID NO: 1031821 - protein, 223 aa, Homo sapiens
PLWTEPPLSCCLPATYPADMGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKCRKSKESEDPQKPGSSGLSESCSTANGEKDSITLISMKNINMNNGKQSLSAEKI

SEQ ID NO: 1031822 - protein, 260 aa, Homo sapiens
PLWTEPPLSCCLPATYPADMGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGMESGGEPTLARGRQAESSPVQQRSGTHFAPGASYHSVISFIVILVVVVIILVGVVSLRFKCRKSKESEDPQKPGSSGLSESCSTANGEKDSITLISMKNINMNNGKQSLSAEKVL

SEQ ID NO: 1031823 - protein, 224 aa, Homo sapiens
PLWTEPPLSCCLPATYPADMGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKCRKSKESEDPQKPGSSGLSESCSTANGEKDSITLISMKNINMNNGKQSLSAEKVL

SEQ ID NO: 1031824 - protein, 224 aa, Homo sapiens; identical to SEQ ID NO: 1031823

SEQ ID NO: 1031825 - protein, 797 aa, Homo sapiens
MQDGNFLLSALQPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 1031826 - protein, 797 aa, Homo sapiens; identical to SEQ ID NO: 1031825

SEQ ID NO: 1031827 - protein, 776 aa, Homo sapiens
MSGTNLTLSHNSITFRLRVQLAPLTLLNFSTQDIGCAQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 1031828 - protein, 824 aa, Homo sapiens
MQDGNFLLSALQPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKVRGAVWRRAVPRAAALTRAPAPRPLPQSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 1031829 - protein, 815 aa, Homo sapiens
EGLGCRSSGARSQKPERVLEASVGGEGVLGPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 1031830 - protein, 839 aa, Homo sapiens
MQDGNFLLSALQPEAGVCSLALPSDLQLDRRGAEGPEAERLRAARVQEQVRARLLQLGQQPRHNGAAEPEPEAETARGTSRGQYHTLQAGFSSRSQGLSGDKTSVSDGPSPRGTIWALQSGEWEALQRARTQVSPGTPLTAPFDPQGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 1031831 - protein, 383 aa, Homo sapiens
MQDGNFLLSALQPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQVTTPTTHSLPPGDLLRGPHHLPLSSAH

SEQ ID NO: 1031832 - protein, 188 aa, Homo sapiens
SFAGGGERGEHAMKASGTLREYKVVGRCLPTPKCHTPPLYRMRIFAPNHVVAKSRFWYFVSQLKKMKKSSGEIVYCGQVFEKSPLRVKNFGIWLRYDSRSGTHNMYREYRDLTTAGAVTQCYRDMGARHRARAHSIQIMKVEEIAASKCRRPAVKQFHDSKIKFPLPPRVLRRQHKPRFTTKRPNPFF

SEQ ID NO: 1031833 - protein, 188 aa, Homo sapiens; identical to SEQ ID NO: 1031832

SEQ ID NO: 1031834 - protein, 188 aa, Homo sapiens; identical to SEQ ID NO: 1031832

SEQ ID NO: 1031835 - protein, 218 aa, Homo sapiens
SFAGGGERGEHAMKASGTLREYKVVGRCLPTPKCHTPPLYRMRIFAPNHVVAKSRFWYFVSQLKKMKKSSGGDRASRVGQGVLRNGPPLRVEGTPGDRGLAVIDSRRGGTPQTLYRGKYGGPLNHRRRGQPTGGLTEHNGVCAANPAPRAPTPIPRSWEGGRKIRGQAKVAAGPGLGKEQVPGLPKIKGPPLAPKAGPWRRQEKAQVQPSKEAKNLSS

SEQ ID NO: 1031836 - protein, 144 aa, Homo sapiens
SFAGGGERGEHAMKASGTLREYKVVGRCLPTPKCHTPPLYRMRIFAPNHVVAKSRFWYFVSQLKKMKKSSGEIVYCGQVFEKSPLRVKNFGIWLRYDSRSGTHNMYREYRDLTTAGAVTQCYARYGSPDRCCTGSVHAHHEAWK

SEQ ID NO: 1031837 - protein, 469 aa, Homo sapiens
LLLQRLDQRSHCVPLWVALAPRNSRRLCLERFSACRSQGAPAHRLRGHTRMLAIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQVNLGQGPP

SEQ ID NO: 1031838 - protein, 436 aa, Homo sapiens
DHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQVNLGQGPP

SEQ ID NO: 1031839 - protein, 498 aa, Homo sapiens
LLLQRLDQRSHCVPLWVALAPRNSRRLCLERFSACRSQGAPAHRLRGHTRMLAIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKAELADRPNPPTRPLPADPVVRSPKSQGPAKPPPQGSHCLRPQAGAIVVTARPGAESRLVVPP

SEQ ID NO: 1031840 - protein, 474 aa, Homo sapiens
LLLQRLDQRSHCVPLWVALAPRNSRRLCLERFSACRSQGAPAHRLRGHTRMLAIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSLRGQPSPHPKEATACDPRPVPSGDCPAGAESRLVVPP

SEQ ID NO: 1031841 - protein, 326 aa, Homo sapiens
LLLQRLDQRSHCVPLWVALAPRNSRRLCLERFSACRSQGAPAHRLRGHTRMLAIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVSSLGGQDQV

SEQ ID NO: 1031842 - protein, 148 aa, Homo sapiens
MHRAAQSGPSERPGPPQRALLARGTKVSPGCQRKGTPPWPGIQLGPWGVRIKGSRLRERLALPKSQSKESGPALPSPPLATGREAESRRVGRAASWSRSCWAPSAGQEVALRGGSIHAPSSDPRRAQGQWCSEWPSVGPGHHVRKAAG

SEQ ID NO: 1031843 - protein, 499 aa, Homo sapiens
LLLQRLDQRSHCVPLWVALAPRNSRRLCLERFSACRSQGAPAHRLRGHTRMLAIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQSQGPAKPPPQGSHCLRPQAGAIVVTARPGAESRLVVPP

SEQ ID NO: 1031844 - protein, 437 aa, Homo sapiens
LLLQRLDQRSHCVPLWVALAPRNSRRLCLERFSACRSQGAPAHRLRGHTRMLAIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQ

SEQ ID NO: 1031845 - protein, 451 aa, Homo sapiens
LLLQRLDQRSHCVPLWVALAPRNSRRLCLERFSACRSQGAPAHRLRGHTRMLAIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRVSGASQAPTPRKPLPATPGRCHRVTARPGAESRLVVPP

SEQ ID NO: 1031846 - protein, 385 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKL

SEQ ID NO: 1031847 - protein, 550 aa, Homo sapiens [sequence omitted]

SEQ ID NO: 1031848 - protein, 529 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKRRGARAASSPAFLTTTNSPRASLPASRMSPERTPGQNRTSATGSPARAGAGPPETGLLTGTSGRGAGPGGPAAGRTGGHARSGGPTRSTPTRMTAPAGAARARTTPGPGGPTAKTGTGGSGAGSGGAAPAGSTAATAAEASGRAPGPRAGTAVPGTGNDGHGLPTACPGKTRTCSSLLAAPWPLSVHPCKAKTLLQPRMSTEPAGRKEDTML

SEQ ID NO: 1031849 - protein, 418 aa, Homo sapiens
MPAGLAPPHWRGRWGVLVLTVCVLCFRPKVPEAMAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKL

SEQ ID NO: 1031850 - protein, 258 aa, Homo sapiens
MDGLDLARRRRRPPPLGWSPARPLILHPHARRFRAPVVWSPRMALQRRGARAASSPAFLTTTNSPRASLPASRMSPERTPGQNRTSATGSPARAGAGPPETGLLTGTSGRGAGPGGPAAGRTGGHARSGGPTRSTPTRMTAPAGAARARTTPGPGGPTAKTGTGGSGAGSGGAAPAGSTAATAAEASGRAPGPRAGTAVPGTGNDGHGLPTACPGKTRTCSSLLAAPWPLSVHPCKAKTLLQPRMSTEPAGRKEDTML

SEQ ID NO: 1031851 - protein, 550 aa, Homo sapiens [sequence omitted]

SEQ ID NO: 1031852 - protein, 373 aa, Homo sapiens
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGTRIKLETIILSKLSQGQKTKHRVFSLIGGAGALAKECMSLYPGCKITVFDIPEVVWTAKQHFSFQEEEQIDFQEGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 1031853 - protein, 451 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKVPGGSLCSRQPRPGCPQCPPLKCGRRHGAVFPAGCSCSYETSFNAEDDGSFPGGCSARLSFPMISEL

SEQ ID NO: 1031854 - protein, 298 aa, Homo sapiens
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 1031855 - protein, 556 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEESSVSGWLFPTLPAGSVLLEDKRSRGSGSHGWIGDKMGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGTRIKLETIILSKLSQGQKTKHRVFSLIGGN

SEQ ID NO: 1031856 - protein, 342 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERYLLRDGPSALVSGTWECAQTRVRVSACIPVRVCVHACL

SEQ ID NO: 1031857 - protein, 451 aa, Homo sapiens; identical to SEQ ID NO: 1031853

SEQ ID NO: 1031858 - protein, 185 aa, Homo sapiens
MSPERTPGQNRTSATGSPARAGAGPPETGLLTGTSGRGAGPGGPAAGRTGGHARSGGPTRSTPTRMTAPAGAARARTTPGPGGPTAKTGTGGSGAGSGGAAPAGSTAATAAEASGRAPGPRAGTAVPGTGNDGHGLPTACPGKTRTCSSLLAAPWPLSVHPCKAKTLLQPRMSTEPAGRKEDTML

SEQ ID NO: 1031859 - protein, 320 aa, Homo sapiens [sequence omitted]

SEQ ID NO: 1031860 - protein, 682 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEESSVSGWLFPTLPAGSVLLEDKRSRGSGSHGWIGDKMGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGWGWSSGKECMSLYPGCKITVFDIPEVVWTAKQHFSFQEEEQIDFQEGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 1031861 - protein, 334 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKTKHSRTAQKLITNLSNS

SEQ ID NO: 1031862 - protein, 373 aa, Homo sapiens; identical to SEQ ID NO: 1031852

SEQ ID NO: 1031863 - protein, 550 aa, Homo sapiens [sequence omitted]

SEQ ID NO: 1031864 - protein, 373 aa, Homo sapiens; identical to SEQ ID NO: 1031852

SEQ ID NO: 1031865 - protein, 550 aa, Homo sapiens [sequence omitted]

SEQ ID NO: 1031866 - protein, 101 aa, Homo sapiens
VSLPGVLGYPSFCCSGKEPAQMEYKTDAPQPDVKEEEEEKEEEKDKGDEEEEGEEKLEEKQKSDAEEDGGTVSQEEEDRKPKAEEDEILNRSPRNRKPRRE

SEQ ID NO: 1031867 - protein, 101 aa, Homo sapiens; identical to SEQ ID NO: 1031866

SEQ ID NO: 1031868 - protein, 101 aa, Homo sapiens; identical to SEQ ID NO: 1031866

SEQ ID NO: 1031869 - protein, 101 aa, Homo sapiens; identical to SEQ ID NO: 1031866

SEQ ID NO: 1031870 - protein, 102 aa, Homo sapiens
LEAFLVSWVIPPSAVLEKTQPSWSIRTDAPQPDVKEEEEEKEEEKDKGDEEEEGEEKLEEKQKSDAEEDGGTVSQEEEDRKPKAEEDEILNRSPRNRKPRRE

SEQ ID NO: 1031871 - protein, 101 aa, Homo sapiens; identical to SEQ ID NO: 1031866

SEQ ID NO: 1031872 - protein, 102 aa, Homo sapiens; identical to SEQ ID NO: 1031870

SEQ ID NO: 1031873 - protein, 101 aa, Homo sapiens; identical to SEQ ID NO: 1031866

SEQ ID NO: 1031874 - protein, 101 aa, Homo sapiens; identical to SEQ ID NO: 1031866

SEQ ID NO: 1031875 - protein, 101 aa, Homo sapiens; identical to SEQ ID NO: 1031866

SEQ ID NO: 1031876 - protein, 101 aa, Homo sapiens; identical to SEQ ID NO: 1031866

SEQ ID NO: 1031877 - protein, 111 aa, Homo sapiens
CWSVRYFAFRCCWVVSVCLRSACGLFISPPPLLLFFPISFSRFSFLLLAPREWSRWGWHPRCARLRVVVFFLCGGGLVLLCVRLVCLLCGVSSPLPLLDVGFCSFQSIVPV

SEQ ID NO: 1031878 - protein, 102 aa, Homo sapiens; identical to SEQ ID NO: 1031870

SEQ ID NO: 1031879 - protein, 101 aa, Homo sapiens; identical to SEQ ID NO: 1031866

SEQ ID NO: 1031880 - protein, 101 aa, Homo sapiens; identical to SEQ ID NO: 1031866

SEQ ID NO: 1031881 - protein, 101 aa, Homo sapiens; identical to SEQ ID NO: 1031866

SEQ ID NO: 1031882 - protein, 101 aa, Homo sapiens; identical to SEQ ID NO: 1031866

SEQ ID NO: 1031883 - protein, 101 aa, Homo sapiens; identical to SEQ ID NO: 1031866

SEQ ID NO: 1031884 - protein, 101 aa, Homo sapiens; identical to SEQ ID NO: 1031866

SEQ ID NO: 1031885 - protein, 108 aa, Homo sapiens
MEYKTDAPQPDVKEEEEEKEEEKDKGDEEEEGEEKLEEKQKSDAEEDGGTVSQEEEDRKPKAWHLGIYIPLGRVRLWPSGAGGLLRNASRAWHVSSGIDVFITSSTVC

SEQ ID NO: 1031886 - protein, 101 aa, Homo sapiens; identical to SEQ ID NO: 1031866

SEQ ID NO: 1031887 - protein, 101 aa, Homo sapiens; identical to SEQ ID NO: 1031866

SEQ ID NO: 1031888 - protein, 101 aa, Homo sapiens; identical to SEQ ID NO: 1031866

SEQ ID NO: 1031889 - protein, 101 aa, Homo sapiens; identical to SEQ ID NO: 1031866

SEQ ID NO: 1031890 - protein, 101 aa, Homo sapiens; identical to SEQ ID NO: 1031866

SEQ ID NO: 1031891 - protein, 101 aa, Homo sapiens; identical to SEQ ID NO: 1031866

SEQ ID NO: 1031892 - protein, 778 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATSKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 1031893 - protein, 574 aa, Homo sapiens
MATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 1031894 - protein, 574 aa, Homo sapiens; identical to SEQ ID NO: 1031893

SEQ ID NO: 1031895 - protein, 574 aa, Homo sapiens; identical to SEQ ID NO: 1031893

SEQ ID NO: 1031896 - protein, 574 aa, Homo sapiens; identical to SEQ ID NO: 1031893

SEQ ID NO: 1031897 - protein, 574 aa, Homo sapiens; identical to SEQ ID NO: 1031893

SEQ ID NO: 1031898 - protein, 574 aa, Homo sapiens; identical to SEQ ID NO: 1031893

SEQ ID NO: 1031899 - protein, 574 aa, Homo sapiens; identical to SEQ ID NO: 1031893

SEQ ID NO: 1031900 - protein, 469 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNWRSANWPFPIVGQTGWPPWPLGAMGLWP

SEQ ID NO: 1031901 - protein, 348 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQPVPTSLPTLVPLVSSGLSEMLDIAINRSSLSPV

SEQ ID NO: 1031902 - protein, 350 aa, Homo sapiens
LYGLGTRLGGGFFLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 1031903 - protein, 218 aa, Homo sapiens
MPRMCPTRSPRQPLSPKMLPHLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 1031904 - protein, 296 aa, Homo sapiens
MLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 1031905 - protein, 574 aa, Homo sapiens; identical to SEQ ID NO: 1031893

SEQ ID NO: 1031906 - protein, 574 aa, Homo sapiens; identical to SEQ ID NO: 1031893

SEQ ID NO: 1031907 - protein, 574 aa, Homo sapiens; identical to SEQ ID NO: 1031893

SEQ ID NO: 1031908 - protein, 574 aa, Homo sapiens; identical to SEQ ID NO: 1031893

SEQ ID NO: 1031909 - protein, 442 aa, Homo sapiens
DLVPGAGRQGAQVACPEASAASPRGRGWGSRCPPWAARFTLCGHSPWGPKSLPEGRPVELRGCWARVCGPQSPLNLTVPQIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 1031910 - protein, 190 aa, Homo sapiens
AAADPEVGQRAERGRRGRGGEEPGRGGEEPAGEGRSPAGREGSGAFPAGLSRTPSPSRGHQEKIRQRQSILPPPQGPAPIPFQHRGGDSPEAKNRVGPQVPLSEPGGPRGWRGLHRARCGGLGEQPPCPPSGFRRRESQEEPRAVLAQKIEKETQILNCALDDIEPGGPRGWRGLHRARCGGLGEQPPCP

SEQ ID NO: 1031911 - protein, 174 aa, Homo sapiens
DLVPGAGRQGAQVACPEASAASPRGRGWGSRCPPWAARFTLCGHSPWGPKSLPEGRPVELRGCWARVCGPQSPLNLTVPQIVNTCSGPDIARSVSCPLLSRDAVDFLRGHLVPKEMSLWESLGESWMRPREGRAEQCRGFMGGQRCMGASKGVLVGQFWRGRADFRTSHPSSEW

SEQ ID NO: 1031912 - protein, 327 aa, Homo sapiens
MSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGCQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 1031913 - protein, 327 aa, Homo sapiens; identical to SEQ ID NO: 1031912

SEQ ID NO: 1031914 - protein, 327 aa, Homo sapiens; identical to SEQ ID NO: 1031912

SEQ ID NO: 1031915 - protein, 715 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAEGVLTLRARPPSEGEFIDCFQKIKLAINLLAKLQKHIQNPSAAELVHFLFGPLDLIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 1031916 - protein, 327 aa, Homo sapiens; identical to SEQ ID NO: 1031912

SEQ ID NO: 1031917 - protein, 613 aa, Homo sapiens
AAADPEVGQRAERGRRGRGGEEPGRGGEEPAGEGRSPAGREGSGAFPAGLSRTPSPSRGHQEKIRQRQSILPPPQGPAPIPFQHRGGDSPEAKNRVGPQVPLSEPGGPRGWRGLHRARCGGLGEQPPCPPSGFRRRESQEEPRAVLAQKIEKETQILNCALDDIEWFVARLQKAAEAFKQLNQRKKGKKKGKKAPAEGVLTLRARPPSEGEFIDCFQKIKLAINLLAKLQKHIQNPSAAELVHFLFGPLDLIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 1031918 - protein, 334 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAGAGDRDGAGRCRGRGQQVQGTGTGTPGTSMGATHGG

SEQ ID NO: 1031919 - protein, 122 aa, Homo sapiens
MSQSGAVSCCPGATNGSLGRSDGVAKMSPKDLFGELRFENGLDVTVGEMGTASRWGTAAPAPQLCLVWPRGSPGAQGGLWTLINLPKAPGHWIPSPTPVRGEAFTNNSGSINIDSAALIAVT

SEQ ID NO: 1031920 - protein, 114 aa, Homo sapiens
NQEARSCLGSGQALGPKEEGHFLPALHRAHLWRLPRKCSGQPRVNTLALPLWDHSPGTQTLGHAHSHPYPGPAAGALGPCMGLGRPVPLHLVLVQLTAVAAGATRCVHCTLALF

SEQ ID NO: 1031921 - protein, 759 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAEGVLTLRARPPSEGEFIDCFQKIKLAINLLAKLQKHIQNPSAAELVHFLFGPLDLIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDGESCCFEAGVPGPGHLGEEVWGGSLGRGRGQGQGSGGPESRAPSELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 1031922 - protein, 660 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 1031923 - protein, 223 aa, Homo sapiens [sequence omitted]

SEQ ID NO: 1031924 - protein, 223 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPARHTLPRIPLWKGDHSRV

SEQ ID NO: 1031925 - protein, 57 aa, Homo sapiens
MSQSGAVSCCPGATNGSLGRSDGVAKMSPKDLFPPQRERHPTEERHPTERARDPLDH

SEQ ID NO: 1031926 - protein, 327 aa, Homo sapiens; identical to SEQ ID NO: 1031912

SEQ ID NO: 1031927 - protein, 327 aa, Homo sapiens; identical to SEQ ID NO: 1031912

SEQ ID NO: 1031928 - protein, 284 aa, Homo sapiens
ASGERWWKGGFSRFCEQQDPPEGLTVEVALHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 1031929 - protein, 240 aa, Homo sapiens
MDQDGDQQLGPSRILAPQTLKEIDDVYEKYKKEDDLNQKKRLQQLLQRALINSQELGDEKIQIVTQMLELVENRARQMELHSQCFQDPAESERASDKAKMDSSQPERSSRRPRRQRTSESRDLCHMANGIEDCDDQPPKEKKSKSAKKKKRSKAKQEREASPVEFAIDPNEPTYCLCNQVSYGEMIGCDNEQCPIEWFHFSCVSLTYKPKGKWYCPKCRGDNEKTMDKSTEKTKKDRRSR

SEQ ID NO: 1031930 - protein, 280 aa, Homo sapiens
MLGQQQQQLYSSAALLTGERSRLLTCYVQDYLECVESLPHDMQRNVSVLRELDNKYQETLKEIDDVYEKYKKEDDLNQKKRLQQLLQRALINSQELGDEKIQIVTQMLELVENRARQMELHSQCFQDPAESERASDKAKMDSSQPERSSRRPRRQRTSESRDLCHMANGIEDCDDQPPKEKKSKSAKKKKRSKAKQEREASPVEFAIDPNEPTYCLCNQVSYGEMIGCDNEQCPIEWFHFSCVSLTYKPKGKWYCPKCRGDNEKTMDKSTEKTKKDRRSR

SEQ ID NO: 1031931 - protein, 280 aa, Homo sapiens; identical to SEQ ID NO: 1031930

SEQ ID NO: 1031932 - protein, 245 aa, Homo sapiens
MLGQQQQQLYSSAALLTGERSRLLTCYVQDYLECVESLPHDMQRNVSVLRELDNKYQETLKEIDDVYEKYKKEDDLNQKKRLQQLLQRALINSQELGDEKIQIVTQMLELVENRARQMELHSQCFQDPAESERASDKAKMDSSQPERSSRRPRRQRTSESRDLCHMANGIEDCDDQPPKEKKSKSAKKKKRSKAKQGKGKLSPVWSFALGSLLEPYIVYWQPKCFFWGEVVRGVGPLNQCSLDWV

SEQ ID NO: 1031933 - protein, 292 aa, Homo sapiens
CSEAMSAAFLRPAGGGGADEELPPSAVTAHAPHCWGGRAVRPTSNELRGWPCELLADLCENMDNACRLLPAVWHAPAGGPGTLDVLCGLAGTCVCAGLAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 1031934 - protein, 267 aa, Homo sapiens
CSEAMSAAFLRPAGGGGADEELPPSAVTAHAPHCWGGRAVRPTSNELRGWPCELLADLCENMDNACRLLPAVWHAPAGGPGTLDVLCGLAGTCVCAGLAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEESFSDVRKHEAWIHVS

SEQ ID NO: 1031935 - protein, 222 aa, Homo sapiens
MKMPKLSSFLDPLLWAVPGGGGGTRWRPGQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 1031936 - protein, 222 aa, Homo sapiens; identical to SEQ ID NO: 1031935

SEQ ID NO: 1031937 - protein, 178 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 1031938 - protein, 183 aa, Homo sapiens
GSPGLQEYSKMSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDGVHTRRNRRLPKIVDST

SEQ ID NO: 1031939 - protein, 156 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKYIPEDILKNLVEELPQPRKIPKRLDGVHTRRNRRLPKIVDST

SEQ ID NO: 1031940 - protein, 173 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDGVHTRRNRRLPKIVDST

SEQ ID NO: 1031941 - protein, 173 aa, Homo sapiens; identical to SEQ ID NO: 1031940

SEQ ID NO: 1031942 - protein, 162 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDGNQDCI

SEQ ID NO: 1031943 - protein, 149 aa, Homo sapiens
MQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDGVHTRRNRRLPKIVDST

SEQ ID NO: 1031944 - protein, 173 aa, Homo sapiens; identical to SEQ ID NO: 1031940

SEQ ID NO: 1031945 - protein, 107 aa, Homo sapiens
GSPGLQEYSKMSSFSRAPQQWATFARIWYLLDGKMQPPGKLAAMASIRLQGLHKPVYHALSDCGDHVVIMNTRHIAFVTFHLFPQVHLKYLEQLFCFLEPDFAHSSP

SEQ ID NO: 1031946 - protein, 109 aa, Homo sapiens
GGISGSLRLGRLEIMSSVGFPQFFHQARYFGSYSLNNCIICSFHDEIAAVEKTGGNSRKREKPTSARRARNCPAWVLAFPAGPVRLSDPAWLLGEGRTVLLVEEYVEFL

SEQ ID NO: 1031947 - protein, 173 aa, Homo sapiens; identical to SEQ ID NO: 1031940

SEQ ID NO: 1031948 - protein, 158 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDGI

SEQ ID NO: 1031949 - protein, 213 aa, Homo sapiens
MSSFSRAPQVSSDSYGLMGFIILAEGERWFRQIKYEAGAAGKPRPSAKRQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDGVHTRRNRRLPKIVDST

SEQ ID NO: 1031950 - protein, 178 aa, Homo sapiens; identical to SEQ ID NO: 1031937

SEQ ID NO: 1031951 - protein, 147 aa, Homo sapiens
LTLSLYIPLPCFKKNSVHVSPEMLCDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDGVHTRRNRRLPKIVDST

SEQ ID NO: 1031952 - protein, 178 aa, Homo sapiens; identical to SEQ ID NO: 1031937

SEQ ID NO: 1031953 - protein, 173 aa, Homo sapiens; identical to SEQ ID NO: 1031940

SEQ ID NO: 1031954 - protein, 154 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDDLKIIGYKRIRIAENNSEVIETFF

SEQ ID NO: 1031955 - protein, 246 aa, Homo sapiens
PSAPGFLLQQAWVTLSLGLSAAILVPRSLHKMPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 1031956 - protein, 333 aa, Homo sapiens
SSGIIAHSAHYGLGHSKYFLCLLAVYPQPILAFFRAKPPRGLRVKDELEALLGHRVPTRPWASGQNGVCGWCPGKSRVEGLRGGPRIRACRDGSSCSVEGGRGVRLVLGTASQDPEKEMPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 1031957 - protein, 215 aa, Homo sapiens
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 1031958 - protein, 206 aa, Homo sapiens
YSTGCYCVHMIGKKGSSRSLIGDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 1031959 - protein, 134 aa, Homo sapiens
PSAPGFLLQQAWVTLSLGLSAAILVPRSLHKMPGEATETVPATEQELPQPQAETGSGTESDSDESVPELEEQDSTQATTQQAQLAAAAEIDEEPVSKAKQSRSEKKARKAMSKLGLRQVTGVTRVTIRSRISGS

SEQ ID NO: 1031960 - protein, 208 aa, Homo sapiens
MSYYAINAHPSSLCIAHPGIPTHYGELICTQVTYVLAGHAAANWMNEPVKYSQIPTQSDMRPERYGTAMSNIWRLRAGYYGTLTSRSSIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 1031961 - protein, 113 aa, Homo sapiens
MSGEEEREEVKFNNAFWGGGDDGGGDVAAEKFKVQGEAVSNIQENTQTPTVQEESEEEEVDETGVEVKDIELVMSQANVSRAKAVRALKNTSIDMVNADNGIPWYPFEIYPFE

SEQ ID NO: 1031962 - protein, 246 aa, Homo sapiens; identical to SEQ ID NO: 1031955

SEQ ID NO: 1031963 - protein, 136 aa, Homo sapiens
MSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 1031964 - protein, 293 aa, Homo sapiens
PSAPGFLLQQAWVTLSLGLSAAILVPRSLHKMPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSHSHTLLLDEQKRTPPDAPAHETNSLTDYLLTLSTYCDTYTTPANPLLRNATLFSFWLLIQQRSLHWHPSGFLHNFC

SEQ ID NO: 1031965 - protein, 243 aa, Homo sapiens
MIAQSQRNREHKNNNTRKRKKARSRRESDHPIKKRDTRQTHYNKHDTYQPRERRGHAGAGEKDGEDRRGADERERHKKRKPRKGARGGGRKAGEPNNRTADPEARKDEGEWMSIPINSKVIYDRRDKRGNSEREERQDRKEKKETERTEQNRKEKRLAHANRNRNIKKDKSNGKQGEQQGERRKGRKQTTTGKNRRHSNRYKPEKEQDEGNTKDGRATRENARAGGKERTMQKATDNKERKQQ

SEQ ID NO: 1031966 - protein, 1135 aa, Homo sapiens
MHQMNAKMHFRFVFALLIVSFNHDVLGKNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEQVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 1031967 - protein, 1135 aa, Homo sapiens; identical to SEQ ID NO: 1031966

SEQ ID NO: 1031968 - protein, 1135 aa, Homo sapiens; identical to SEQ ID NO: 1031966

SEQ ID NO: 1031969 - protein, 90 aa, Homo sapiens
ERSGDRYDHDDEVERGSRRVVKLDRVILRVRAAAMVTRFLGPRYRELVKNWVPTAYTWGAVGAWGWFGLIDWLLILDWVPYINGKFKKDN

SEQ ID NO: 1031970 - protein, 109 aa, Homo sapiens
RPSEILSPKKKKKKATEANESAWEWSLWGIPVRVTQVMSLPKPWSLLPPAGLVNYHISVKCSNQFKLEVCLLKSDNKVVDNQAGTQGQLKVLGANLWWPYLMHEHHARR

SEQ ID NO: 1031971 - protein, 131 aa, Homo sapiens
NACRASPGLVNYHISVKCSNQFKLEVCLLKSDNKVVDNQAGTQGQLKVLGANLWWPYLMHEHPAYLYSWEDGDCSHQSLGPLPACDLCDQLHLRSRQGGSVCGCDPCEQLLLLVSQLRAPGVDSAAAGRPV

SEQ ID NO: 1031972 - protein, 140 aa, Homo sapiens
MDRSNPVKPALDYFSNRLVNYHISVKCSNQFKLEVCLLKSDNKVVDNQAGTQGQLKVLGANLWWPYLMHEHPAYLYSWEDGDCSHQSLGPLPACDLCDQLHLRSRQGGSVCGCDPCEQLLLLVSQLRAPGVDSAAAGRPV

SEQ ID NO: 1031973 - protein, 188 aa, Homo sapiens
MVIAHTKALDPSQPVTFVTNSTYAADKGALYVDVIRVNSYYSWYRNYGHLELIQLQLAAQFENGVRHHNPIIQSAYGVETLVGFHQSFPGNSDEVFQQNERVNQEEDDIRSRRYNRGDNLQDACEERSLDPRMIIGQVVHNASRPEDFQGNSFKEVKMMDDSSKMKMDQPQWLTPVIPVTLWEAEAGG

SEQ ID NO: 1031974 - protein, 151 aa, Homo sapiens
ETERDSFSKKKKEKATEANESAWEWSLWGIPVRVTQVMSLPKPWSLLPPAGLVNYHISVKCSNQFKLEVCLLKSDNKVVDNQAGTQGQLKVLGANLWWPYLMHEHPAYLYSWEVMVVWDLLKGGLLLPSGSPGFSRSPGQVNGQVWSFELF

SEQ ID NO: 1031975 - protein, 131 aa, Homo sapiens; identical to SEQ ID NO: 1031971

SEQ ID NO: 1031976 - protein, 174 aa, Homo sapiens
ETERDSFSKKKKEKATEANESAWEWSLWGIPVRVTQVMSLPKPWSLLPPAGLVNYHISVKCSNQFKLEVCLLKSDNKVVDNQAGTQGQLKVLGANLWWPYLMHEHPAYLYSWEDGDCSHQSLGPLPACDLCDQLHLRSRQGGSVCGCDPCEQLLLLVSQLRAPGVDSAAAGRPV

SEQ ID NO: 1031977 - protein, 188 aa, Homo sapiens; identical to SEQ ID NO: 1031973

SEQ ID NO: 1031978 - protein, 452 aa, Homo sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRVGSLWWPSESLRPTEHSDNGIVALPSGGQGAGPPGLRHGLHTRRMPSSNYGNSGGPLVNLDGEVIGINTLKVTAGISFAIPSDRITRFLTEFQDKQIKDCKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 1031979 - protein, 357 aa, Homo sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRRGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKAPSLAVH

SEQ ID NO: 1031980 - protein, 452 aa, Homo sapiens; identical to SEQ ID NO: 1031978

SEQ ID NO: 1031981 - protein, 453 aa, Homo sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRRGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKDWKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 1031982 - protein, 280 aa, Homo sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRRGEFVVAIGSPFASLLASLFLLRQDPPGA

SEQ ID NO: 1031983 - protein, 357 aa, Homo sapiens; identical to SEQ ID NO: 1031979

SEQ ID NO: 1031984 - protein, 452 aa, Homo sapiens; identical to SEQ ID NO: 1031978

SEQ ID NO: 1031985 - protein, 498 aa, Homo sapiens
MSILASNQFQGTQPSSLHPLRSSSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 1031986 - protein, 480 aa, Homo sapiens
MSILASNQFQGTQPSSLHPLRSSSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPAQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 1031987 - protein, 213 aa, Homo sapiens
NRRPHLALYDLTISTPTLAESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 1031988 - protein, 142 aa, Homo sapiens
MSILASNQFQGTQPSSLHPLRSSSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQVSCVS

SEQ ID NO: 1031989 - protein, 498 aa, Homo sapiens; identical to SEQ ID NO: 1031985

SEQ ID NO: 1031990 - protein, 268 aa, Homo sapiens
MSILASNQFQGTQPSSLHPLRSSSHGSQPSVRTPLPNLHPGLVSTPISPQLVNLSMIRSFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 1031991 - protein, 498 aa, Homo sapiens; identical to SEQ ID NO: 1031985

SEQ ID NO: 1031992 - protein, 253 aa, Homo sapiens
MTTEMGEARHVRTLSSERCPRLLASCAVVLWVCHTLPCFCSHWEAHSWLTSPSQGPTWEPGSLDCPGHRFQGPPLLSSEPRGILLLKNTYGIPICAGQCPKHLDYIREEHRPHPCPHAAYVFWRKVETQVLGFRAPPAGGCAVRSGREGKCTAACEPYQPRRMPLPLSTTLGLLHPLASVSSHLSKNEGAPWGPGPCARGNQAAFQTSGAEADYEGRLELGDTAHSLSGQIRSPGPLTQACHLERGKRERGFS

SEQ ID NO: 1031993 - protein, 153 aa, Homo sapiens
GQSLPSPGVKRPIENRKLILPTRNETEYKIRDQKGGLRNIILNVLKRPDLPRINPSFTYYQIQEKTSTCPASRNLTHRQSIFGQLMGSFSNQDKSSLSPKLLEIIAGSMLALFITQPLAREISKSMTVKVSETASPQVTYAGPNTWFQEILLL

SEQ ID NO: 1031994 - protein, 218 aa, Homo sapiens
MVLQLFAHVPYNHNNHHPPPNPPHTPTPQTTTPTTQHPHAHTHSTAQSTQNEQASTTVARQPGAHRSAERTSEDTDDQGEGDATRPQHQRRNSTMHPPTRHTRKERQRKPTEGTRRASNTNERGGGPRENETTRKNNKTRKEKDSSRRRNRHQQTGRNETREAADETPARAEAEEGATHPTDRHRTNDSTQQNALTTTPNTDAPDNAEPQAEATTQRA

SEQ ID NO: 1031995 - protein, 198 aa, Homo sapiens
MLAGVVVSCQESLQTSGASCSCCACSWTATSARRSGRAPRPCTDQCSRTWLPRPYIRLAGVLTHLPAPGPSISAPGKTSKGTGSGQPRAPGFKQEVNRLRELEEAKHQGQRRPHADQPDEARACPCHRPDPSPLCKSLPLPPPRPPLLSARDGPLCLAHPSAAPPSHLLFPKASVSIALVSLGLSPPHPPSSVSLSLM

SEQ ID NO: 1031996 - protein, 226 aa, Homo sapiens
WGWIWAQQFAGTAGQESLMAKLLGSVSPTSCSGGPMEQEQKHTLEKLNLKDRTYSIEVITAVLAQPAPGPHEALISQAIPGLCALATLPGATAKASAELDHKACYLCHSLLMLAGVVVSCQDITPDQWGELQLLCMQLDRHISTQIRESPQAMHRTNAQGPGYPDLTSVWQELLTHLPAPGPVFQPLERHLKGQGQGNPGLLASAGSEQAQGTGGSEASRPEEATC

SEQ ID NO: 1031997 - protein, 131 aa, Homo sapiens
SRGSPNACAAPPIFLQDIKKPDCDDWESGLNAMECALHLEKNVNQSLLELHKLATDKNDPHLCDFMRRSSPRVVGVSCFNSAWTEPGARSPPRPAAHSQPSVTSSPHPRTAPRPPPPLQRRAATAAAAASP

SEQ ID NO: 1031998 - protein, 134 aa, Homo sapiens
EHVITLMNLLTSTWAFSFTISSNPNSSDLENPSDAMECALHLEKNVNQSLLELHKLATDKNDPHLCDFMRRSSPRVVGVSCFNSAWTEPGARSPPRPAAHSQPSVTSSPHPRTAPRPPPPLQRRAATAAAAASP

SEQ ID NO: 1031999 - protein, 134 aa, Homo sapiens; identical to SEQ ID NO: 1031998

SEQ ID NO: 1032000 - protein, 134 aa, Homo sapiens; identical to SEQ ID NO: 1031998

SEQ ID NO: 1032001 - protein, 134 aa, Homo sapiens; identical to SEQ ID NO: 1031998

SEQ ID NO: 1032002 - protein, 72 aa, Homo sapiens
SRGSPNACAAPPIFLQDIKKPDCDDWESGLNAMECALHLEKNVNQSLLELHKLATDKNDPHLCDFIETHLPE

SEQ ID NO: 1032003 - protein, 134 aa, Homo sapiens; identical to SEQ ID NO: 1031998

SEQ ID NO: 1032004 - protein, 102 aa, Homo sapiens
LGAGPPIVLCSPAGVWHARCLVVGDYMMYLPGWSPCWGGPPTAFGAPLIWPPVVDCGGCCSSLESVSPRLLFLRCCVAPPPLCFCVYPHHGIIMAFGVYARV

SEQ ID NO: 1032005 - protein, 72 aa, Homo sapiens; identical to SEQ ID NO: 1032002

SEQ ID NO: 1032006 - protein, 79 aa, Homo sapiens
MRRGNHAEKLMKLQNQRGGRIFSDTEPDCMTGERLMHECHTLEKCDQYYWTAQLALQNAPFVYSLAIPIGGKHQIGHVH

SEQ ID NO: 1032007 - protein, 134 aa, Homo sapiens; identical to SEQ ID NO: 1031998

SEQ ID NO: 1032008 - protein, 151 aa, Homo sapiens
REHAPDIRTYAGQTPQGCELDAYIRPSTSWWIDERIAVCSQAGDRARPPAAHSSLVTLTTSEPKPAAPAPRSHRRRRRLSLVAAMTTASTSQVRQNYHQDSEAAINRQINLELYASYVYLSMSYYFDRDDVALKNFAKYFLHQSHEEREPC

SEQ ID NO: 1032009 - protein, 134 aa, Homo sapiens; identical to SEQ ID NO: 1031998

SEQ ID NO: 1032010 - protein, 134 aa, Homo sapiens; identical to SEQ ID NO: 1031998

SEQ ID NO: 1032011 - protein, 89 aa, Homo sapiens
MNAGYDTKTAARHTDSTQQLRRNESDSQRTELAAAHTTEKYTVGEQPHTSEDGETRQPEDTTEVGNPSNETNTNLTKHKPKTATAERQQ

SEQ ID NO: 1032012 - protein, 134 aa, Homo sapiens; identical to SEQ ID NO: 1031998

SEQ ID NO: 1032013 - protein, 134 aa, Homo sapiens; identical to SEQ ID NO: 1031998

SEQ ID NO: 1032014 - protein, 72 aa, Homo sapiens; identical to SEQ ID NO: 1032002

SEQ ID NO: 1032015 - protein, 72 aa, Homo sapiens; identical to SEQ ID NO: 1032002

SEQ ID NO: 1032016 - protein, 128 aa, Homo sapiens
MRRGNHAEKLMKLQNQRGGQPAFSHLPSRRAEGAGSGTETAEPLAAREEGCVLSRHRICPPLDGSSATMCRPAQEVTLGASRRWSGIQDRGSFSGEAYLSCVAADGSKTLFSHQCLLACFLSYLNSHL

SEQ ID NO: 1032017 - protein, 67 aa, Homo sapiens
CPGGGIYFRYGTPLTGFQEEPITFGPAKTELGKRPNLAWRNISLTSTPWETVIMKAKPRANFPIAVG

SEQ ID NO: 1032018 - protein, 230 aa, Homo sapiens
GTCYHTHESANLNVGIFLHDIHNPNWSDLENPWDAMECALHLEKNVNQSLLELHKLATDKNDPHLCDFMRRSSPRVVGVSCFNSAWTEPGARSPPRPAAHSQPSVTSSPHPRTAPRPPRTDLIQAPGQPPDGGRRRLLLILHAHDSTAVLPSARLRTQKTEPRQVIVQDVSADSDSAQYLQAGRHLTAPPYDFPWSSGRIPNVMHPSTDVALKNFAKYFLHQSHEEREPC

SEQ ID NO: 1032019 - protein, 134 aa, Homo sapiens; identical to SEQ ID NO: 1031998

SEQ ID NO: 1032020 - protein, 134 aa, Homo sapiens; identical to SEQ ID NO: 1031998

SEQ ID NO: 1032021 - protein, 552 aa, Homo sapiens
TFYTIRWHLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASLYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 1032022 - protein, 552 aa, Homo sapiens; identical to SEQ ID NO: 1032021

SEQ ID NO: 1032023 - protein, 552 aa, Homo sapiens; identical to SEQ ID NO: 1032021

SEQ ID NO: 1032024 - protein, 552 aa, Homo sapiens; identical to SEQ ID NO: 1032021

SEQ ID NO: 1032025 - protein, 435 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032026 - protein, 476 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSLRRFHDYLRRFDSLPDMLELGSPHSSGRCELGHNGALKEGY

SEQ ID NO: 1032027 - protein, 435 aa, Homo sapiens; identical to SEQ ID NO: 1032025

SEQ ID NO: 1032028 - protein, 417 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGDNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032029 - protein, 561 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSLRRFHDYLRRFDSLPDMLELGSPHSSGRCELGHNGALKEGYNIAILVANDIHLEQEGDEDGSGSSHLDTGLKIWDLNRESLQEPSGSKRGIICRPRVKKSRGIAKQGHLENKTREHGGINHLATAKNGLAGVHQPHG

SEQ ID NO: 1032030 - protein, 417 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032031 - protein, 473 aa, Homo sapiens
LFCCWVTFCLLVTFLLLFLAPGIVPGPPVILNEDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032032 - protein, 435 aa, Homo sapiens; identical to SEQ ID NO: 1032025

SEQ ID NO: 1032033 - protein, 428 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032034 - protein, 503 aa, Homo sapiens
MSRFVQDLSKAMSQDGASQFQEVIRQELELSVKKELEKILTTASSHEFEHTGFCHIAEAGLKTPELKRSAGLSLPKCWDYRHAPTTPSLYELLGCEKVLLPPCPNGHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032035 - protein, 428 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYVVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032036 - protein, 561 aa, Homo sapiens
MSQDGASQFQEVIRQELELSVKKELEKILTKDHHLNVEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSLRRFHDYLRRFDSLPDMLELGSPHSSGRCELGHNGALKEGYNIAILVANDIHLEQEGDEDGSGSSHLDTGLKIWDLNRESLQEPSGSKRGIICRPRVKKSRGIAKQGHLENKTREHGGINHLATAKNGLAGVHQPHG

SEQ ID NO: 1032037 - protein, 326 aa, Homo sapiens
MGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032038 - protein, 243 aa, Homo sapiens
LFCCWVTFCLLVTFLLLFLAPGIVPGPPVILNEDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQKASSLKNSPALNRFQRSKKLFWGNKF

SEQ ID NO: 1032039 - protein, 371 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAWYVWLAIHRGL

SEQ ID NO: 1032040 - protein, 296 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKVNTERKQFRASCFHIS

SEQ ID NO: 1032041 - protein, 428 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGDNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032042 - protein, 465 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSLRRFHDYLRRFDSLPDMLELGSPHSSGRCELGHNGALKEGY

SEQ ID NO: 1032043 - protein, 561 aa, Homo sapiens; identical to SEQ ID NO: 1032029

SEQ ID NO: 1032044 - protein, 435 aa, Homo sapiens; identical to SEQ ID NO: 1032025

SEQ ID NO: 1032045 - protein, 452 aa, Homo sapiens
MGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSLRRFHDYLRRFDSLPDMLELGSPHSSGRCELGHNGALKEGYNIAILVANDIHLEQEGDEDGSGSSHLDTGLKIWDLNRESLQEPSGSKRGIICRPRVKKSRGIAKQGHLENKTREHGGINHLATAKNGLAGVHQPHG

SEQ ID NO: 1032046 - protein, 326 aa, Homo sapiens; identical to SEQ ID NO: 1032037

SEQ ID NO: 1032047 - protein, 428 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032048 - protein, 179 aa, Homo sapiens
MNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTGALVKLGSSFTKVPRLSKKI

SEQ ID NO: 1032049 - protein, 163 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVLWLMTL

SEQ ID NO: 1032050 - protein, 147 aa, Homo sapiens
MAVMAPRTLVLLLSGALALTQTWAGSHSMRYFFTSVSRPGRGEPRFIAVGCVGGARFVRGGGAAGGGGRAGGRGGGGGGGAGGGGARGGGGARGRGGAGSAGGGGVGCGGARGPGAPAAAGVASPWGGPALLGRGGRWRLEVARRGW

SEQ ID NO: 1032051 - protein, 152 aa, Homo sapiens
MAVMAPRTLLLLLWGAVALTETWAGSHSMRYFYTAMSRPGRGEPRFIAVGYVDDTQFVRFDSDAASPRDGAAGAMDRAGGAGVLGPGDTDHARPTHRLTERTCGSLAAPLLQPERGRVSHPARGCMAATWGRTGASSAGMTSTPTTARITSP

SEQ ID NO: 1032052 - protein, 152 aa, Homo sapiens; identical to SEQ ID NO: 1032051

SEQ ID NO: 1032053 - protein, 152 aa, Homo sapiens; identical to SEQ ID NO: 1032051

SEQ ID NO: 1032054 - protein, 152 aa, Homo sapiens; identical to SEQ ID NO: 1032051

SEQ ID NO: 1032055 - protein, 152 aa, Homo sapiens; identical to SEQ ID NO: 1032051

SEQ ID NO: 1032056 - protein, 152 aa, Homo sapiens; identical to SEQ ID NO: 1032051

SEQ ID NO: 1032057 - protein, 152 aa, Homo sapiens; identical to SEQ ID NO: 1032051

SEQ ID NO: 1032058 - protein, 152 aa, Homo sapiens; identical to SEQ ID NO: 1032051

SEQ ID NO: 1032059 - protein, 152 aa, Homo sapiens; identical to SEQ ID NO: 1032051

SEQ ID NO: 1032060 - protein, 247 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAARGPPKDTCDPQPTLISDHEVTLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 1032061 - protein, 152 aa, Homo sapiens; identical to SEQ ID NO: 1032051

SEQ ID NO: 1032062 - protein, 159 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAARGPPKDTCDPQPTSSQPTIPIVGIVAGLAVLAVVVIGAVVATVMCRRKSSGGKGGSCSQAASSNSAQGSDVSLTA

SEQ ID NO: 1032063 - protein, 250 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAAHGRPQNAYDSPPLTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 1032064 - protein, 158 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAARGPPKTHVTQHLTHHPVSDHEATLRCWALGFYPAEITLTWQRDGEDQTQDTELVETRPAGDRTFQWASLLAWLS

SEQ ID NO: 1032065 - protein, 275 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAAHGRPQNAYDSPPLTHHPVSDHEATLRCWALGFYPAEITLTWQRDGEDQTQDTELVETRPAGDGTFQKWAAVVVPSGQEQRYTCHVQHEGLPKPLTLRWEPSSQPTIPIVGIVAGLAVLSLWSCDHWSCGRCCDVDGGSMLFDFLIWYGSVLSVLQAVTVPRALICLSQLVKCETAALCGTERQELFLPFPL

SEQ ID NO: 1032066 - protein, 202 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAARGPPKTHVTQHLTHHPVSDHEATLRCWALGFYPAEITLTWQRDGEDQTQDTELVETDPGDKLQKWPCGGSGRAGSLPVRLGLPASPGGPSARPGLVPAPPDPALFNLGGYFGPAFRTC

SEQ ID NO: 1032067 - protein, 152 aa, Homo sapiens; identical to SEQ ID NO: 1032051

SEQ ID NO: 1032068 - protein, 152 aa, Homo sapiens; identical to SEQ ID NO: 1032051

SEQ ID NO: 1032069 - protein, 152 aa, Homo sapiens; identical to SEQ ID NO: 1032051

SEQ ID NO: 1032070 - protein, 152 aa, Homo sapiens; identical to SEQ ID NO: 1032051

SEQ ID NO: 1032071 - protein, 152 aa, Homo sapiens; identical to SEQ ID NO: 1032051

SEQ ID NO: 1032072 - protein, 152 aa, Homo sapiens; identical to SEQ ID NO: 1032051

SEQ ID NO: 1032073 - protein, 152 aa, Homo sapiens; identical to SEQ ID NO: 1032051

SEQ ID NO: 1032074 - protein, 152 aa, Homo sapiens; identical to SEQ ID NO: 1032051

SEQ ID NO: 1032075 - protein, 152 aa, Homo sapiens; identical to SEQ ID NO: 1032051

SEQ ID NO: 1032076 - protein, 249 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAARGPPKTHVTQHLTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 1032077 - protein, 245 aa, Homo sapiens
MYGCDVGPDGRLLRGYDQYAYDGKDYIALNEDLSSWTAADTAAQITQRKWEAARVAEQLRAYLEGTVRGVAPQIPGEREGDAAARGPPKTHVTQHPISDHEVTLRCWALGFYPAEITLTWQRDGEDQTQDTELVETRPAGDRTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 1032078 - protein, 113 aa, Homo sapiens
SCWSSLRGFLPEPLLSLVNHTGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 1032079 - protein, 193 aa, Homo sapiens
ALVPYKVLPEGPEAVGGRLCFRSPARGFRCQAPGCVLHAPAGRSLRASVLLQPHASSCMWRLAPAAARRVRAFALNCSWRGAYTRFPCERVLLGASCRDYLLPDVHDSVLYRLCLQPLPLRAGPAAAAPETPEPAECVEFTAEPAGMQDIVVAMTAVGGSICVMLVVICLLVAYITENLMRPALARPGLRRHP

SEQ ID NO: 1032080 - protein, 69 aa, Homo sapiens
DRPEEGGGVKCKINVLGNPPPACGPTCCRPGPRAEVAFCDDRLVTLDTRRVMALPSPPGAPGTDHLDLT

SEQ ID NO: 1032081 - protein, 115 aa, Homo sapiens
MAGPCGSGRPCPSKSHGHSGSPRTSILCRIVPDRPSPLLGHCALQAWGAALQACPAPPHPTGLRLASCLSISGPLQEPTPSAVQGGSVALRLAGLSMHLASVPLETPSPSSAAEA

SEQ ID NO: 1032082 - protein, 421 aa, Homo sapiens
HASTNDSFEIRPAPKPVMETIPLGDLQARALASLRANSRNSFMVIPKSKASGAPPPEGRQSVELPKGDLGPASPSQELGSQPVPGGDGAPALGKSPLEVEAQWAVEEGACPRTATALADRAIRWQRPSSPPPFLPAASEEAEPAEGLRVPGLAKNSREYVRPGLPVTFIDEVDSEEAPQAAKLPYLPHPARPLHPARPGCVAELQPRGSNTFTVVPKRKPGLCRTSTSVRPTGSLGHEEAEEEEASCLLGPTLKKRYPTVHEIEVIGGYLACRSPAQQGWLLKKEDEDLFNDKSLQTTFEYPSESSLEQEEEVDQQEEEEEEEEEEEEEEEGSGSEEKPFALFLPRATFVSSVRPESSRLPEGSSGLSSYTPKHSVAFSKWQEQALEQAPREAEPPPVEAMLTPASQNDLSDFRSEPALYF

SEQ ID NO: 1032083 - protein, 379 aa, Homo sapiens
MKLSLLRASGAPPPEGRQSVELPKGDLGPASPSQELGSQPVPGGDGAPALGKSPLEVEAQWAVEEGACPRTATALADRAIRWQRPSSPPPFLPAASEEAEPAEGLRVPGLAKNSREYVRPGLPVTFIDEVDSEEAPQAAKLPYLPHPARPLHPARPGCVAELQPRGSNTFTVVPKRKPGLCRTSTSVRPTGSLGHEEAEEEEASCLLGPTLKKRYPTVHEIEVIGGYLACRSPAQQGWLLKKEDEDLFNDKSLQTTFEYPSESSLEQEEEVDQQEEEEEEEEEEEEEEEGSGSEEKPFALFLPRATFVSSVRPESSRLPEGSSGLSSYTPKHSVAFSKWQEQALEQAPREAEPPPVEAMLTPASQNDLSDFRSEPALYF

SEQ ID NO: 1032084 - protein, 379 aa, Homo sapiens; identical to SEQ ID NO: 1032083

SEQ ID NO: 1032085 - protein, 483 aa, Homo sapiens
MGQKSSSGIRVCLTGQLGVSGSCSQMSPATPILSPSPFPLPSLCSASQALCWAGQSRCAQRGSGPPMTSSTRSARSGRGSGRSTRMGAKGPTSQGSGTACTTSSSSSSTQACAWATRPRPSASAAAGTSLKQRASAKAVCRASTLRRTSATFSWAPAGRPRTLDSRASTVPCSSWVRLRDSTSVSSSAWLRRRLSGGRWPHSPHSSCTFPGRAGAVGVTPHCMWSISSSVSCSWARCPGHGVCSASVSPQSARRPGGGSVLTGSRGAQSSPAVSSDPPPNPLQGLQPQPPVPRALPPSWAGSDATSSSDFSSTTSTAWLTERFSSTLQRRPLRARSTTPVTLLATTSLAEVTTVSEELLEKGKLLFQLVQAPAGEAVHSGQLGLQVLEQRLGVVQGTGGQAAHAVLSQAAGGAQQRVPVLGCTVNIADRGARGPDQGQSHHTLHHVLLVLLPHTGSGDLSRLFFRHRAANRVTWARAASDTSC

SEQ ID NO: 1032086 - protein, 686 aa, Homo sapiens
RGCSGARAAMAAGGGGSCDPLAPAGVPCAFSPHSQAYFALASTDGHLRVWETANNRLHQEYVPSAHLSGTCTCLAWAPARLQAKESPQRKKRKSEAVGMSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNKVLQTRNVNLIKKTVLRMPLHTIIPLLQELTKRLQGHPNSAVLMVQWLKCVLTVHASYLSTLPDLVPQLGTLYQLMESRVKTFQKLSHLHGKLILLITQVTASEKTKGATSPGQKAKLVYEEESSEEESDDEIADKDSEDNWDEDEEESESEKDEDVEEEDEDAEGKDEENGEDRDTASEKELNGDSDLDPENESEEE

SEQ ID NO: 1032087 - protein, 616 aa, Homo sapiens
NSPCIMEVPEYQGLIFLERKKRKSEAVGMSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNKVLQTRNVNLIKKTVLRMPLHTIIPLLQELTKRLQGHPNSAVLMVQWLKCVLTVHASYLSTLPDLVPQLGTLYQLMESRVKTFQKLSHLHGKLILLITQVTASEKTKGATSPGQKAKLVYEEESSEEESDDEIADKDSEDNWDEDEEESESEKDEDVEEEDEDAEGKDEENGEDRDTASEKELNGDSDLDPENESEEE

SEQ ID NO: 1032088 - protein, 686 aa, Homo sapiens; identical to SEQ ID NO: 1032086

SEQ ID NO: 1032089 - protein, 656 aa, Homo sapiens
RGCSGARAAMAAGGGGSCDPLAPAGVPCAFSPHSQAYFALASTDGHLRVWETANNRLHQEYVPSAHLSGTCTCLAWAPARLQAKESPQRKKRKSEAVGMSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNKVLQTRNVNLIKKTVLRMPLHTIIPLLQELTKRLQGHPNSAVLMVQWLKCVLTVHASYLSTLPDLVPQLGTLYQLMESRVKTFQKLSHLHGKLILLITQVTASEKTKGATSPGQKAKLVYEEESSEEESDDEIADKDSEDNWDEDEEESESEKDEDVEEERRKYGEME

SEQ ID NO: 1032090 - protein, 491 aa, Homo sapiens
RGCSGARAAMAAGGGGSCDPLAPAGVPCAFSPHSQAYFALASTDGHLRVWETANNRLHQEYVPSAHLSGTCTCLAWAPARLQAKESPQRKKRKSEAVGMSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNVSI

SEQ ID NO: 1032091 - protein, 686 aa, Homo sapiens; identical to SEQ ID NO: 1032086

SEQ ID NO: 1032092 - protein, 524 aa, Homo sapiens
MLFFSSQYSKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNKVLQTRNVNLIKKTVLRMPLHTIIPLLQELTKRLQGHPNSAVLMVQWLKCVLTVHASYLSTLPDLVPQLGTLYQLMESRVKTFQKLSHLHGKLILLITQVTASEKTKGATSPGQKAKLVYEEESSEEESDDEIADKDSEDNWDEDEEESESEKDEDVEEEDEDAEGKDEENGEDRDTASEKELNGDSDLDPENESEEE

SEQ ID NO: 1032093 - protein, 530 aa, Homo sapiens
RGCSGARAAMAAGGGGSCDPLAPAGVPCAFSPHSQAYFALASTDGHLRVWETANNRLHQEYVPSAHLSGTCTCLAWAPARLQAKESPQRKKRKSEAVGMSNQTDLLALGTAVGSILLYSTVKGELHSKLISGGHDNRVNCIQWHQDSGCLYSCSDDKHIVEWNVQTCKVKCKWKGDNSSVSSLCISPDGKMLLSAGRTIKLWVLETKEVYRHFTGHATPVSSLMFTTIRPPNESQPFDGITGLYFLSGAVHDRLLNVWQVRSENKEKSAVMSFTVTDEPVYIDLTLSENKEEPVKLAVVCRDGQVHLFEHILNGYCKKPLTSNCTIQIATPGKGKKSTPKPIPILAAGFCSDKMSLLLVYGSWFQPTIERVALNSREPHMCLVRDISNCWAPKVETAITKVRTPVMNSEAKVLVPGIPGHHAAIKPAPPQTEQVESKRKSGGNEVSIEERLGAMDIDTHKKGKEDLQTNSFPVLLTQGLESNDFEMLNKVLQTRNVNLIKKTVLRMPLHTIIPLLQEVTDCFFHFSILMP

SEQ ID NO: 1032094 - protein, 129 aa, Homo sapiens
ISSEPPASASQSAGITGVSHARTAIPSNISEASCPEKEGWVERTVPAAVGLGQETGTHLRGLWRVYVHTAAGPPPPATCSSPTSPPGHPADIKSASRNVPTHEGFLGAEPGAPATSGGGLLVTSDLLSS

SEQ ID NO: 1032095 - protein, 143 aa, Homo sapiens
MRFNPASCVGAFLFLPVATEVARVRLLRRLRRRRRRECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032096 - protein, 133 aa, Homo sapiens
GLQEFGTSTEVARVRLLRRLRRRRRRECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032097 - protein, 139 aa, Homo sapiens
AHASADSALGATEVARVRLLRRTPPLRRRRRRECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032098 - protein, 135 aa, Homo sapiens
MLTARCGPGVESATEVARVRLLRRRRRRECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032099 - protein, 135 aa, Homo sapiens; identical to SEQ ID NO: 1032098

SEQ ID NO: 1032100 - protein, 214 aa, Homo sapiens
RLRRTEVFCHLLWLFYEPPSSFCEQFLCPNAHLCLQFGEFFLVHDCFFHSLFGSENYTGGPRRGTRVGAQGVSRWTTVRLWRTHAGTQATEVARVRLLRRLRRRRRRECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032101 - protein, 90 aa, Homo sapiens
PFLFLPVATEVARVRLLRRLRRRRRRVISELNGKNIEDVIAQGIGKLASVPAGGAVAVSAAPRLLRAPAAWGSAPACSRREKKDEKKEES

SEQ ID NO: 1032102 - protein, 193 aa, Homo sapiens
RLRRTEVFCHLLWLFYEPPSSFCEQFLCPNAHLCLQFGEFFLVHDCFFHSLFGSENYTGGPRRGTRVGAQGVSRWTTVRLWRTHAGTQATEVARVRLLRRLRRRRRRECAYVASYLLACPRGQPPPPAPKDIKKILDSVGIEADDDRLNKVISELNGTVAVSAAPRLLRAPAAWGSAPACSRREKKDEKKEES

SEQ ID NO: 1032103 - protein, 109 aa, Homo sapiens
LLGGHEVNARGLYPYPQQVSSPSAKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032104 - protein, 143 aa, Homo sapiens; identical to SEQ ID NO: 1032095

SEQ ID NO: 1032105 - protein, 143 aa, Homo sapiens; identical to SEQ ID NO: 1032095

SEQ ID NO: 1032106 - protein, 133 aa, Homo sapiens; identical to SEQ ID NO: 1032096

SEQ ID NO: 1032107 - protein, 135 aa, Homo sapiens; identical to SEQ ID NO: 1032098

SEQ ID NO: 1032108 - protein, 214 aa, Homo sapiens; identical to SEQ ID NO: 1032100

SEQ ID NO: 1032109 - protein, 139 aa, Homo sapiens; identical to SEQ ID NO: 1032097

SEQ ID NO: 1032110 - protein, 132 aa, Homo sapiens
AHASADSALGATEVARVRLLRRTPPECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032111 - protein, 143 aa, Homo sapiens; identical to SEQ ID NO: 1032095

SEQ ID NO: 1032112 - protein, 105 aa, Homo sapiens
MIILREEAPPLSFRRAITAPIFLLDSQGGGAPYYMGGRLLLYNSAETDRGDALVFYNTKLALRDCADTNRLLDKRLERTLLCGERRHTTSRSLGGGGSRDTNMCA

SEQ ID NO: 1032113 - protein, 143 aa, Homo sapiens; identical to SEQ ID NO: 1032095

SEQ ID NO: 1032114 - protein, 117 aa, Homo sapiens
MCIQQVGGDVAHRGGVCGGAAEKSHACDLGGDREEKKILDSVGIEADDDRLNKVISELNGKNIEDVIAQGIGKLASVPAGGAVAVSAAPRLLRAPAAWGSAPACSRREKKDEKKEES

SEQ ID NO: 1032115 - protein, 166 aa, Homo sapiens
MCKKALFAGEQEFNQKGQIPCHHLTLSDSFLNMIYLPPSAATRCRTSEHGMKMWARMDGYSPTSRYTGKLANTLGNSSPSAKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032116 - protein, 143 aa, Homo sapiens; identical to SEQ ID NO: 1032095

SEQ ID NO: 1032117 - protein, 105 aa, Homo sapiens; identical to SEQ ID NO: 1032112

SEQ ID NO: 1032118 - protein, 105 aa, Homo sapiens; identical to SEQ ID NO: 1032112

SEQ ID NO: 1032119 - protein, 184 aa, Homo sapiens
MGEEPHYIIYGHRGRRGPRAAFIQQPPLCRKSGNNRARPHAWGANSLAGSEEGHPPYLLCAGGAAGEHYMWRTHNTLTPLYARKYIFIKRAILLEEGGHHLYNNTFLYRAALLRLAGACPIQPKQRAPHIYVPCGPRCCDEEQMFVCRLPNAASELYVDLFCGYNDHFFFLYHSRGGARVCKSA

SEQ ID NO: 1032120 - protein, 125 aa, Homo sapiens
LKREFKRRVRLLRRRRRRECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032121 - protein, 134 aa, Homo sapiens
LRGQRNSANSVATEVARVRLLRRRRRRECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032122 - protein, 214 aa, Homo sapiens; identical to SEQ ID NO: 1032100

SEQ ID NO: 1032123 - protein, 97 aa, Homo sapiens
CPIQAILLPDPATCWRVRGEARFSLVGDFLDREVISELNGKNIEDVIAQGIGKLASVPAGGAVAVSAAPRLLRAPAAWGSAPACSRREKKDEKKEES

SEQ ID NO: 1032124 - protein, 132 aa, Homo sapiens; identical to SEQ ID NO: 1032110

SEQ ID NO: 1032125 - protein, 135 aa, Homo sapiens
MCIQQVGGDVAHRGGVCGGAAEKSHACDLGGDREEKKILDSVGIEADDDRLNKVISELNGKNIEDVIAQGIGKLASVPAGGGEGVWGGPGWPAPVAGSGPGAVHHKEHEVKGECGQAHDLSAVSRMLVEEEVPCL

SEQ ID NO: 1032126 - protein, 34 aa, Homo sapiens
MRNHPTENYRPGEINHAVWGNNEYARLKWQGVNI

SEQ ID NO: 1032127 - protein, 79 aa, Homo sapiens
MRSLPRAPLREETPGDTPGSGDHANKYPPCGKRADCRPCFTPLIKEAPVSFNKEKVQPPCGAEHRCDQDTNLSGDAIGR

SEQ ID NO: 1032128 - protein, 134 aa, Homo sapiens; identical to SEQ ID NO: 1032121

SEQ ID NO: 1032129 - protein, 152 aa, Homo sapiens
AALYSTGQVVLHRQVVLHRQVVLHRQVVLHGNGCTLRRLRRRRRRDCAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032130 - protein, 154 aa, Homo sapiens
MRGGRRGIFGTEAYGPSHARPQPGGPGMGRQEAAGVTPPSRPLRPPQECAYVASYLLACPRGQPPPPAPKDIKKILDSVGIEADDDRLNKVISELNGKNIEDVIAQGIGKLASVPAGGAVAVSAAPRLLRAPAAWGSAPACSRREKKDEKKEES

SEQ ID NO: 1032131 - protein, 106 aa, Homo sapiens
MGAAKSLADTLVRRRGRGSPGPGNQRPSGRKVPGRDREEWQNQVGRNYDPQKGQGASLRAPPGYKVQLPRPKGLWVLCPGGTHARSCDRGKAGNPQWTRGRKPQES

SEQ ID NO: 1032132 - protein, 185 aa, Homo sapiens
MGEEPHYIIYGHRGRRGPRAAFIQQPPLCRKSGNNRARPHAWGANSLAGSEEGHPPYLLCAGGAAGEHYMWRTHNTLTPLYARKYIFIKRAILLEEGGHHLYNNTFLYRAALLRLAGACPIQPKQRAPHIYVPCGPRCCDEEQMFVCRLPNAASELYVDLFCGVQRPLFFFISLARRRPGVQIST

SEQ ID NO: 1032133 - protein, 108 aa, Homo sapiens
MIKLLLPWRKGFVRIGKNRVLVYLSSPADLCGRFLCCGLLSDAFLAASVRYFYYPDPSTPQIPPFPSLCAVFHPPPRLPRFQFPAHDVFFTLFAPFRTPVSIAFRMFL

SEQ ID NO: 1032134 - protein, 135 aa, Homo sapiens; identical to SEQ ID NO: 1032098

SEQ ID NO: 1032135 - protein, 131 aa, Homo sapiens
MRFNPASCVGAFLFLPVATEVARVRLLRRLRRRRRRECAYVASYLLACPRGQPPPPAPKDIKKILDSVISELNGKNIEDVIAQGIGKLASVPAGGAVAVSAAPRLLQAPAAWGSAPACSRREKKDEKKEES

SEQ ID NO: 1032136 - protein, 111 aa, Homo sapiens
MRRRRSLEESDDDMGRRSSPSGKDVKKILDRVGYREQEDDDRTQQRSSDELSGKNIERQSLTRGIGKLAQVYLLVGLYPCSADPRIWKPLTAGSSPCLQAEANTDDTDGRA

SEQ ID NO: 1032137 - protein, 197 aa, Homo sapiens
AGIKPHCVDAIFSGILSAAEEWTATSLSTGIEICAIEVNKVPIISSKSPTALPIFLGEVYEFGKSMSSRYALMLLFIKKYSWSLIQSLKTNARTPAVSSRKKIIPRNTETNLRRKVFSRSAPMHPANPKMNITPPTTRKSQTGSKPPRSVMEEMLDRTPFSFHAHSPIPRNVIPKNQNMTLKPNMKYLMQQLTSGPL

SEQ ID NO: 1032138 - protein, 197 aa, Homo sapiens; identical to SEQ ID NO: 1032137

SEQ ID NO: 1032139 - protein, 197 aa, Homo sapiens; identical to SEQ ID NO: 1032137

SEQ ID NO: 1032140 - protein, 216 aa, Homo sapiens
AGIKPHCVDAIFSGILSAAEEWTATSLSTGIEICAIEVNKVPIISSKSPTALPIFLGEVYEFGKSMSSRYALMLLFIKKYSWSLIQSLKTNARTPAVSSRKKIIPRNTENTYLIPSVRRLFQASFYCLSNLRRKVFSRSAPMHPANPKMNITPPTTRKSQTGSKPPRSVMEEMLDRTPFSFHAHSPIPRNVIPKNQNMTLKPNMKYLMQQLTSGPL

SEQ ID NO: 1032141 - protein, 125 aa, Homo sapiens
MEGKVLALNLRVESVILTNLRRKVFSRSAPMHPANPKMNITPPTTRKSQTGSKPPRSVMEEMLDRTPFSFHAHSPIPRNVIPKKGSAFQLKRRACRKRYLRAITGPYTTASASYTKPEMVLTDRI

SEQ ID NO: 1032142 - protein, 319 aa, Homo sapiens
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFLQTFAIPGSIFLSILSGFLYPFPLALFLVCLCSGLGASFCYMLSYLVGRPVVYKYLTEKAVKWSQQVERHREHLINYIIFLRITPFLPNWFINITSPVIKKQQTQKKKQTNKTKNCVGGPRPPKKVFTAPLSLGRGGPSRKWDMGKTRSQGKPGQTQGREFSNKKTPGGTGGLEHSQGVGASRLHRSHIVHRAGGE

SEQ ID NO: 1032143 - protein, 127 aa, Homo sapiens
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYILYPFN

SEQ ID NO: 1032144 - protein, 291 aa, Homo sapiens
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFLQTFAIPGSIFLSILSGFLYPFPLALFLVCLCSGLGASFCYMLSYLVGRPVVYKYLTEKAVKWSQQVERHREHLINYIIFLRITPFLPNWFINITSPVINVPLKVFFIGTFLGVAPPSFVAIKAGTTLYQLTTAGEAVSWNSIFILMILAVLSILPAIFQKKLKQKFE

SEQ ID NO: 1032145 - protein, 291 aa, Homo sapiens; identical to SEQ ID NO: 1032144

SEQ ID NO: 1032146 - protein, 127 aa, Homo sapiens; identical to SEQ ID NO: 1032143

SEQ ID NO: 1032147 - protein, 198 aa, Homo sapiens
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFLQTFAIPGSIFLSILSGFLYPFPLALFLVCLCSGLGASFCYMLSYLVGRPVVYKYLTEKAVKWSQQCRTSFFCSH

SEQ ID NO: 1032148 - protein, 291 aa, Homo sapiens; identical to SEQ ID NO: 1032144

SEQ ID NO: 1032149 - protein, 291 aa, Homo sapiens; identical to SEQ ID NO: 1032144

SEQ ID NO: 1032150 - protein, 202 aa, Homo sapiens
MSGKLRRSGEAYSGYVSSLLLSNFIDSAKKMLPNNYARGHYTIGKEIIDLVLDRIRKLADQMHRSSEASWFSTALVGELVLGSPPLLMERLSVDYGKKSKLEFSIYPAPQVSTAVVEPYNSILTTHTTLEHSDCAFMVDNEAIYDICRRNLDIERQLYTLARYWQNVSPITVPEIDGALNVTWDSDHCAYPVILLACPFLWK

SEQ ID NO: 1032151 - protein, 192 aa, Homo sapiens
MMRDIISNTTRRARRMPQTTNTAGEEQNQTRRSDTLSWNDDHHPLCVAGRQTRRHTTPTTKYPAARRNNKPHGELEDATTPTRYLCGATENSDKRRREKKKIDGRLDEINHAQRQPEQRHENAHDHSPRPPTPTPRNTETRRSRQTPQHHQNRTPPTRQQQSTPATRTSTPTQNDRQTPPSTERPAPQAGDN

SEQ ID NO: 1032152 - protein, 205 aa, Homo sapiens
MNVRTGILPPASSTLSSSSQARKMLPITMPEGTTAIGKEIIDLVLDRIRKLADQMHRSSVASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYSPHPLPSGHICPCHLC

SEQ ID NO: 1032153 - protein, 205 aa, Homo sapiens; identical to SEQ ID NO: 1032152

SEQ ID NO: 1032154 - protein, 205 aa, Homo sapiens; identical to SEQ ID NO: 1032152

SEQ ID NO: 1032155 - protein, 205 aa, Homo sapiens; identical to SEQ ID NO: 1032152

SEQ ID NO: 1032156 - protein, 205 aa, Homo sapiens; identical to SEQ ID NO: 1032152

SEQ ID NO: 1032157 - protein, 334 aa, Homo sapiens
MNVRTGILPPASSTLSSSSQARKMLPITMPEGTTAIGKEIIDLVLDRIRKLADQMHRSSEASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQCMCVLTIYVRSAEDLSGAHECLTLDKILHRLNSARMASYSPLTISTFSLLELDYYELTLVISAEKAYHEQLSVAEITNACFEPANQMVKCDPRHGKYMACCLLYRGDVVPKDVNAAIATIKTKRTNQAQHPVCGLVPHWLQGWHQLPASHCGAWWRPGQGTESCVHAEQHHSHC

SEQ ID NO: 1032158 - protein, 205 aa, Homo sapiens; identical to SEQ ID NO: 1032152

SEQ ID NO: 1032159 - protein, 205 aa, Homo sapiens; identical to SEQ ID NO: 1032152

SEQ ID NO: 1032160 - protein, 205 aa, Homo sapiens
MNVRTGILPPASSTLSSSSQARKMLPITMPEGTTAIGKEIIDLVLDRIRKLADQMHRSSVASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYSPHPLPSGHICPCHLC

SEQ ID NO: 1032161 - protein, 205 aa, Homo sapiens; identical to SEQ ID NO: 1032160

SEQ ID NO: 1032162 - protein, 188 aa, Homo sapiens
MNVRTGILPPASSTLSSSSQARIIDLVLDRIRKLADQMHRSSVASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYSPHPLPSGHICPCHLC

SEQ ID NO: 1032163 - protein, 147 aa, Homo sapiens
MVNTWLAACCTVVTWFPKMSMLPLPPSRPSVQTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 1032164 - protein, 208 aa, Homo sapiens
MNVRTGILPPASSTLSSSSQARKMLPITMPDYARGHYTIGKEIIDLVLDRIRKLADQMHRSSVASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYSPHPLPSGHICPCHLC

SEQ ID NO: 1032165 - protein, 182 aa, Homo sapiens
MNVRTGILPPASSTLSSSSQARKMLPITMPEGTTAIGKEWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYSPHPLPSGHICPCHLC

SEQ ID NO: 1032166 - protein, 147 aa, Homo sapiens; identical to SEQ ID NO: 1032163

SEQ ID NO: 1032167 - protein, 195 aa, Homo sapiens
MNVRTGILPPASSTLSSSSQARKMLPITMPEGTTAIGKEIIDLVLDRIRKLADQMHRSSVASWFSTALVGELVLGSPPLLMERLSVDYGKKSKLEFSIYPAPQVSTAVVEPYNSILTTHTTLEHSDCAFMVDNEAIYDICRRNLDIERQLYNLTRYWQNVSPITVPEIDGALNVTWDSDHCAYPVILLACPFLWK

SEQ ID NO: 1032168 - protein, 138 aa, Homo sapiens
IDLLENCSSFDVYVFPKSILHSTTSPASNQFGVVPPLPPSLQPPTTLPCVPCETLPKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 1032169 - protein, 205 aa, Homo sapiens
MNVRTGILPPASSTLSSSSQARKMLPITMPEGTTAIGKEIIDLVLDRIRKLADQMHRSSEASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYSPHPLPSGHICPCHLC

SEQ ID NO: 1032170 - protein, 205 aa, Homo sapiens; identical to SEQ ID NO: 1032152

SEQ ID NO: 1032171 - protein, 205 aa, Homo sapiens; identical to SEQ ID NO: 1032160

SEQ ID NO: 1032172 - protein, 205 aa, Homo sapiens; identical to SEQ ID NO: 1032152

SEQ ID NO: 1032173 - protein, 273 aa, Homo sapiens
MNVRTGILPPASSTLSSSSQARKMLPITMPEGTTAIGKEIIDLVLDRIRKLADQMHRSSVASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDRSPRNFHGPEPGCRRNPRIPSIALWPTIVRPCSLVIADEYALPTEIKALTCEAMRIDEKWRMCGRQLEHQHRLTIVDALRPMGKITIGVCLALSV

SEQ ID NO: 1032174 - protein, 205 aa, Homo sapiens; identical to SEQ ID NO: 1032152

SEQ ID NO: 1032175 - protein, 205 aa, Homo sapiens; identical to SEQ ID NO: 1032160

SEQ ID NO: 1032176 - protein, 205 aa, Homo sapiens; identical to SEQ ID NO: 1032152

SEQ ID NO: 1032177 - protein, 205 aa, Homo sapiens; identical to SEQ ID NO: 1032160

SEQ ID NO: 1032178 - protein, 290 aa, Homo sapiens
MPAGSSTAWNTASSPMARCQCDKTIGGGDDSFNTALPSTPSPSADDRAPGERTLPPGLMFCYTLSIAHQSLRLQTLSDTVCLAVSTAQASFQPHEMQSHSTGVQTARCCHTNLCPEGTTAIGKEIIDLVLDRIRKLADQMHRSSEASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYSPHPLPSGHICPCHLC

SEQ ID NO: 1032179 - protein, 288 aa, Homo sapiens
MPAGSSTAWNTASSPMARCQCDKTIGGGDDSFNTPSTPFFSETGAGKHVPRGSVVVYDVCESPIEVIVTEGCVQHGDIAELWQARIPRRCRQARSRRAEGRGLAEARVSVVSLKGTTAIGKEIIDLVLDRIRKLADQMHRSSEASWFSTALVGELVLGSPPLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYSPHPLPSGHICPCHLC

SEQ ID NO: 1032180 - protein, 147 aa, Homo sapiens
MNVRTGILPPASSTLSSSSQARKMLPITMPEGTTAIGKEIIDLVLDRIRKLADQMHRSSVASWFSTALVGELVLGSPPLLMERLSVDYGKKSKLEFSIYPAPQVSTAVVEPYNSILTTHTTLEHSDCAPTGTQLLGVVNEEKLMALL

SEQ ID NO: 1032181 - protein, 126 aa, Homo sapiens
RRRAFSLHEAKSHWYSVSGWGQGGFLFSQHLRLLRPEKLVVDQKPGVLVHPLASPPARPPRALGHRGLSPLSAYVQAEEIGPESNSGGSAVTQPNLRLWQWQGWKLVQWGCRPQVPTLPSPTEYVT

SEQ ID NO: 1032182 - protein, 76 aa, Homo sapiens
GDDERQCGMVVKRVDLEPDGWESWLRYSPTVTLGKEAGSVGLSTTGTNPALPYRVCDVAQPMTASQCFDQSQGQKF

SEQ ID NO: 1032183 - protein, 104 aa, Homo sapiens
RRRAFSLHEAKSHWYSVSGWGQGGFLFSQHLRLLRPEKLVVDQKPGVLVHPLASPPARPPRALGHRGLSPLSAYVQAEEIGPESNSGGSAVTQPNLRLWQWQGW

SEQ ID NO: 1032184 - protein, 575 aa, Homo sapiens
MATYIHVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYDKLKIEDQEREMKLEKLLLLNDKREQAREDLKGLEETVSRELQTLHNLRKLFVQ

SEQ ID NO: 1032185 - protein, 579 aa, Homo sapiens
MWNVAVLPLQVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYDKLKIEDQEREMKLEKLLLLNDKREQAREDLKGLEETVSRELQTLHNLRKLFVQ

SEQ ID NO: 1032186 - protein, 391 aa, Homo sapiens
MAGDLQFSTDSWCVTLSELGHARLLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYDKLKIEDQEREMKLEKLLLLNDKREQAREDLKGLEETVSRELQTLHNLRKLFVQ

SEQ ID NO: 1032187 - protein, 807 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYDKLKIEDQEREMKLEKLLLLNDKREQAREDLKGLEETVSRELQTLHNLRKLFVQ

SEQ ID NO: 1032188 - protein, 595 aa, Homo sapiens
MATYIHVSKTGAEGAVLDEAKNINKSLSALGNVISALAEGTKTHVPYRDSKMTRILQDSLGGNCRTTIVICCSPSVFNEAETKSTLMFGQRVRNQGLGAKPWIPYLRPHSQAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYDKLKIEDQEREMKLEKLLLLNDKREQAREDLKGLEETVSRELQTLHNLRKLFVQ

SEQ ID NO: 1032189 - protein, 1085 aa, Homo sapiens
MDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 1032190 - protein, 416 aa, Homo sapiens
AQEVKAGVSYYLATATQTGQQQDPVSKEQTKNYYNFTSVVFPPKSNNSKVTTRNVSNKPNLRAILQHTCLVLFGTVKVIKNKEHLRNVTVQKWLSGHDDYNIKYPRTQAKTSESSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 1032191 - protein, 499 aa, Homo sapiens
MSNRRRLLVCGSGLAAAGQRPLAMDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGKVFYLSV

SEQ ID NO: 1032192 - protein, 345 aa, Homo sapiens
GYSNRRRLLVCGSGLAAAGQRPLAMDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSENA

SEQ ID NO: 1032193 - protein, 761 aa, Homo sapiens
MGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 1032194 - protein, 894 aa, Homo sapiens
GYSNRRRLLVCGSGLAAAGQRPLAMDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGKNYLDEYNFKFLFLYEKLMVTCVCVCVCDSPMCPPTPIGSCICNTKLIIVLSHDCRIVLCCRDYNSYNLIEGNCPISIHTLTSAFYF

SEQ ID NO: 1032195 - protein, 1085 aa, Homo sapiens; identical to SEQ ID NO: 1032189

SEQ ID NO: 1032196 - protein, 1085 aa, Homo sapiens; identical to SEQ ID NO: 1032189

SEQ ID NO: 1032197 - protein, 94 aa, Homo sapiens
SASGRLAGLRQPRKRLPSSFLLLPSLPFFLPSVLVFLPSLPPCLFPSLLLFLPSVCPCFPPCLFPSLLLFLPSFRLSLCSSLPFLPASFLVLRI

SEQ ID NO: 1032198 - protein, 247 aa, Homo sapiens
ARAARGQRPRPASAPLAVPRPRRGCLGPPSRAAMVGRLSLQDVPELVDAKKKGDGVLDSPDSGLPPSPSPSHWGLAAGGGGGERAAAPGTLEPDAAAATPAAPSPASLPLAPGCALRLCPLSFGEGVEFDPLPPKEVRYTSLVKYDSERHFIDDVQLPLGLAVASCSQTVTCVPNGTWRNYKAEVRFEPRHRPTRFLSTTIVYPKYPKAVYTTTLDYNCRKTLRRFLSSVELEAAELPGSDDLSDEC

SEQ ID NO: 1032199 - protein, 219 aa, Homo sapiens
ARAARGQRPRPASAPLAVPRPRRGCLGPPSRAAMVGRLSLQDVPELVDAKKKGDGVLDSPDSGLPPSPSPSHWGLAAGGGGGERAAAPGTLEPDAAAATPAAPSPASLPLAPGCALRLCPLSFGEGVEFDPLPPKEVRYTSLVKYDSERHFIDDVQLPLGLAVASCSQTVTCVPNGTWRNYKAEVRFEPRHRPTRFLSTTIVYPKYPKAVYSDDLSDEC

SEQ ID NO: 1032200 - protein, 766 aa, Homo sapiens
RVAPGAESILLLLPRRCRGRSTGSFLSVSGVQSQAVGVEKRRQRSWARRGREPQGCSDFWRADPEASDREVPRAAAFRVVGVAPPRMPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRIGRLLRILGRNDDDSSEAMNDILAQVATNTETDKNVGNAILNETVLTIMDIKSESGLRVLAINILGRFLLNNDKNIRYVALTSLLKTVQTDHNAVQRHRSTIVDCLKDYGIGSAKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGEAVWSYLIPGKR

SEQ ID NO: 1032201 - protein, 109 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKK

SEQ ID NO: 1032202 - protein, 705 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRIGRLLRILGRNDDDSSEAMNDILAQVATNTETDKNVGNAILNETVLTIMDIKSESGLRVLAINILGRFLLNNDKNIRYVALTSLLKTVQTDHNAVQRHRSTIVDCLKDYGIRRQQKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGEAVWSYLIPGKRKRPQGKTKLNPDFPARESFEDGRG

SEQ ID NO: 1032203 - protein, 281 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRIGRLLRILGRNDDDSSEAMNDILAQVATNTETR

SEQ ID NO: 1032204 - protein, 552 aa, Homo sapiens
MGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRIGRLLRILGRNDDDSSEAMNDILAQVATNTETDKNVGNAILNETVLTIMDIKSESGLRVLAINILGRFLLNNDKNIRYVALTSLLKTVQTDHNAVQRHRSTIVDCLKDYGIGSAKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGEAVWSYLIPGKR

SEQ ID NO: 1032205 - protein, 121 aa, Homo sapiens
YRSLPLFVEFAHKWNKNWTAGTASNKLWYASLALVTLIMYSIATGGLVLMAVFYTQKDSCMENKILLGVNGGLCLLISLVAISPWVQKSTATLGALTIRGHKLLCHLPHLLSSVQQTCRSR

SEQ ID NO: 1032206 - protein, 295 aa, Homo sapiens
YRSLPLFVEFAHKWNKNWTAGTASNKLWYASLALVTLIMYSIATGGLVLMAVFYTQKDSCMENKILLGVNGGLCLLISLVAISPWVQKSTATLGALTIRGHKLLCHLPHLLSSVQQTCRSSSQMNMGKMLQSVCLTLVKTCTEMKTGDYTGDSLLILCILYSCLTSTTRSSSDALQGRYAAPELEIARCCFCFSPGGEDTEEQQPGKEGPRVIYDEKKGTVYIYSYFHFVFFLASLYVMMTVTNWFNYESANIESFFSGSWSIFWVKMASCWICVLLYLCTLVAPLCCPTREFSV

SEQ ID NO: 1032207 - protein, 109 aa, Homo sapiens
LTVLMSTYFDAKERPWDLIGPQMGFLGLACLGCGHPASTQPCHAMGCSTNPGPRPSHCPQLMVTVLAGSRVDRYALSTAAAQAQYAVRCPLLTTVCQLGLADSVVVTSR

SEQ ID NO: 1032208 - protein, 105 aa, Homo sapiens
MGRDVLDGNMVLEVPYLHPAAPPPTTLECKIASLLTLTLFPGPTPRQVQDSPWCSLRVQTSEALAIQSLQHLNTAQTVRGIRSGVGREGLHLPQIDSMFGPPGCP

SEQ ID NO: 1032209 - protein, 450 aa, Homo sapiens
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 1032210 - protein, 450 aa, Homo sapiens; identical to SEQ ID NO: 1032209

SEQ ID NO: 1032211 - protein, 225 aa, Homo sapiens
MTGSVPSQGPVLEACAALLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 1032212 - protein, 301 aa, Homo sapiens
MRLPKPHSWCLDHTGFSCMEVTAVGEEANQGDLLGFGQAVLFLRKLPPLALPDCGASFPSTARKKRKLAFETGGRTMTGSVPSQGPVLEACAALLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 1032213 - protein, 450 aa, Homo sapiens; identical to SEQ ID NO: 1032209

SEQ ID NO: 1032214 - protein, 176 aa, Homo sapiens
MTGFLLPPASRGTRRSCSRSRKRQTRRRRNPSSFVASCPTLLPFACVPGASPTTLAFPPVVLTGPSTDGIPFALSLQRVPFVLPSPQVASFPLDPLPRADPRHPPPPSPHICCPPLPLHFPSPCPPISISPPTLSPPPTSLPSHPPSLIPSSSPSPYLLLLSLSSLPLIPPPLSHP

SEQ ID NO: 1032215 - protein, 30 aa, Homo sapiens
MLSERARNQSSTWDNSPKGSYFNNPMAPDY

SEQ ID NO: 1032216 - protein, 120 aa, Homo sapiens
MTRGNQRELARQKNMKKQSDSVKGKRRDDGLSAAARKQRDSEIMQQKQNPLALRLCAWSQSHHARVSSCSAHRSQHRWHSLCPESAAGPFCASFPSGSLSPPGPLPGVRGLPLPLGHSRG

SEQ ID NO: 1032217 - protein, 149 aa, Homo sapiens
MEPDGTYRAELSMEYSDFCTVNVHNMLYPKEDKENRILLYRDRNCDYQPGGRTQAAYYVNKITHTKWHETAPRYIGDVYQEPHVAGTRGPTVAQKCGHKGGMCTSKSTTDARGRGRHDAITYVCTGPTLARHCGRVTSSIPECITTASW

SEQ ID NO: 1032218 - protein, 280 aa, Homo sapiens
EYWQVHESNSKTKLQAQTSRDAIQNPNDIQLQEKAWNAVCPLVVRLKRFYEFSIRLEKALQSLLESLTCPPYTPTQHLEREQALAKEFAEILHFTLRFDELKMRNPAIQNDFSYYRRTISRNRINNMHLDIENEVNNEMANRMSLFYAEATPMLKTLSNATMHFVSENKTLPIENTTDCLSTMTSVCKVMLETPEYRSRFTSEETLMFCMRVMVGVIILYDHVHPVGAFCKTSKIDMKGCIKVLKEQAPDSVEGLLNALRFTTKHLNDESTSKQIRAMLQ

SEQ ID NO: 1032219 - protein, 280 aa, Homo sapiens; identical to SEQ ID NO: 1032218

SEQ ID NO: 1032220 - protein, 280 aa, Homo sapiens; identical to SEQ ID NO: 1032218

SEQ ID NO: 1032221 - protein, 178 aa, Homo sapiens
RTRGDLRFRQNTLKSKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQEALVCRFWEAASIALTLAMRS

SEQ ID NO: 1032222 - protein, 178 aa, Homo sapiens
RTRGDLRFRQNTLKSKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 1032223 - protein, 178 aa, Homo sapiens; identical to SEQ ID NO: 1032222

SEQ ID NO: 1032224 - protein, 130 aa, Homo sapiens
RWFAGFWQAARIALSFGHEILSDFALHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 1032225 - protein, 141 aa, Homo sapiens
VFKWTVRMRQLPLFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032226 - protein, 248 aa, Homo sapiens; identical to SEQ ID NO: 738779

SEQ ID NO: 1032227 - protein, 140 aa, Homo sapiens
INAECPLRPGPLFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032228 - protein, 142 aa, Homo sapiens
CSEDPSYERIPPETLKKKRRNFAELKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032229 - protein, 44 aa, Homo sapiens
MGETTHRREKYRARRDDKETKRREKEGNTNANKSDQQDDCDEET

SEQ ID NO: 1032230 - protein, 159 aa, Homo sapiens
TRKVNEAEVAVVLISGVSYCALDRCGRVSSGVMRCSPGGPPCGFFRGVRIHGLTIRRGRPGLGEFTAYMPGPSRQRLPTKRARSSSEFGHELGTCRTQIGVCHQNQRYQWSEPKGSERCCSFFAFVKSSMEPCVKLNKASINMLRIVEPIYCHGGTPKS

SEQ ID NO: 1032231 - protein, 70 aa, Homo sapiens
IFLVIVLCFFIDKLPPCLSKHLLGKLLSQALDLQLCEIPSLFLKGFWHSRNLLLLLFYTLHGSSRKKEGK

SEQ ID NO: 1032232 - protein, 131 aa, Homo sapiens
THASADAWVDPRVRKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032233 - protein, 121 aa, Homo sapiens
CSEDPSYERIPPETLKKKRRNFAELEKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032234 - protein, 248 aa, Homo sapiens [sequence omitted]

SEQ ID NO: 1032235 - protein, 248 aa, Homo sapiens [sequence omitted]

SEQ ID NO: 1032236 - protein, 248 aa, Homo sapiens [sequence omitted]

SEQ ID NO: 1032237 - protein, 248 aa, Homo sapiens [sequence omitted]

SEQ ID NO: 1032238 - protein, 248 aa, Homo sapiens [sequence omitted]

SEQ ID NO: 1032239 - protein, 248 aa, Homo sapiens; identical to SEQ ID NO: 738779

SEQ ID NO: 1032240 - protein, 248 aa, Homo sapiens; identical to SEQ ID NO: 738779

SEQ ID NO: 1032241 - protein, 248 aa, Homo sapiens; identical to SEQ ID NO: 738779

SEQ ID NO: 1032242 - protein, 248 aa, Homo sapiens; identical to SEQ ID NO: 738779

SEQ ID NO: 1032243 - protein, 248 aa, Homo sapiens; identical to SEQ ID NO: 738779

SEQ ID NO: 1032244 - protein, 248 aa, Homo sapiens; identical to SEQ ID NO: 738779

SEQ ID NO: 1032245 - protein, 248 aa, Homo sapiens; identical to SEQ ID NO: 738779

SEQ ID NO: 1032246 - protein, 141 aa, Homo sapiens; identical to SEQ ID NO: 1032225

SEQ ID NO: 1032247 - protein, 141 aa, Homo sapiens; identical to SEQ ID NO: 1032225

SEQ ID NO: 1032248 - protein, 141 aa, Homo sapiens; identical to SEQ ID NO: 1032225

SEQ ID NO: 1032249 - protein, 141 aa, Homo sapiens; identical to SEQ ID NO: 1032225

SEQ ID NO: 1032250 - protein, 141 aa, Homo sapiens
GGGGKTIRLGSEARVAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032251 - protein, 100 aa, Homo sapiens
VFKWTVRMRQLPLFPAGTMEGVEEKKKEVPAVPETLKKKRRNFAELKIKRLRKKFAQKMLRKARRKLIYEKAKHYHKEYRQMYRTEIRMARMARKAGNFY

SEQ ID NO: 1032252 - protein, 141 aa, Homo sapiens; identical to SEQ ID NO: 1032225

SEQ ID NO: 1032253 - protein, 141 aa, Homo sapiens; identical to SEQ ID NO: 1032225

SEQ ID NO: 1032254 - protein, 44 aa, Homo sapiens; identical to SEQ ID NO: 1032229

SEQ ID NO: 1032255 - protein, 123 aa, Homo sapiens
MYSLACVSNKEGETQHALRTKVIDRRVIRHLRSKSFTVEAILMNASIGLRIEALLREWVKPVYVHEGYPRSCKVSHNETQSHQGVDYGRTHPQINKKRIALTDNALIARSLWVKYGHHLHGRI

SEQ ID NO: 1032256 - protein, 123 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032257 - protein, 127 aa, Homo sapiens
SIRLGSEAGVEKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032258 - protein, 127 aa, Homo sapiens; identical to SEQ ID NO: 1032257

SEQ ID NO: 1032259 - protein, 44 aa, Homo sapiens; identical to SEQ ID NO: 1032229

SEQ ID NO: 1032260 - protein, 132 aa, Homo sapiens
MGALFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032261 - protein, 147 aa, Homo sapiens
VEARLGTLWGWNGANPVSAAGDEDPELPREKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVPKGVAASSPSSNLQWNLV

SEQ ID NO: 1032262 - protein, 141 aa, Homo sapiens; identical to SEQ ID NO: 1032225

SEQ ID NO: 1032263 - protein, 141 aa, Homo sapiens; identical to SEQ ID NO: 1032225

SEQ ID NO: 1032264 - protein, 141 aa, Homo sapiens; identical to SEQ ID NO: 1032225

SEQ ID NO: 1032265 - protein, 141 aa, Homo sapiens; identical to SEQ ID NO: 1032225

SEQ ID NO: 1032266 - protein, 141 aa, Homo sapiens; identical to SEQ ID NO: 1032225

SEQ ID NO: 1032267 - protein, 141 aa, Homo sapiens; identical to SEQ ID NO: 1032225

SEQ ID NO: 1032268 - protein, 141 aa, Homo sapiens; identical to SEQ ID NO: 1032225

SEQ ID NO: 1032269 - protein, 133 aa, Homo sapiens
VFKWTVRMRQLPLFPAGTMEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGIIELAQSRRFQLSPRQSS

SEQ ID NO: 1032270 - protein, 248 aa, Homo sapiens; identical to SEQ ID NO: 738779

SEQ ID NO: 1032271 - protein, 248 aa, Homo sapiens; identical to SEQ ID NO: 738779

SEQ ID NO: 1032272 - protein, 248 aa, Homo sapiens; identical to SEQ ID NO: 738779

SEQ ID NO: 1032273 - protein, 248 aa, Homo sapiens; identical to SEQ ID NO: 738779

SEQ ID NO: 1032274 - protein, 248 aa, Homo sapiens [sequence omitted]

SEQ ID NO: 1032275 - protein, 248 aa, Homo sapiens; identical to SEQ ID NO: 738779

SEQ ID NO: 1032276 - protein, 248 aa, Homo sapiens; identical to SEQ ID NO: 738779

SEQ ID NO: 1032277 - protein, 248 aa, Homo sapiens; identical to SEQ ID NO: 738779

SEQ ID NO: 1032278 - protein, 248 aa, Homo sapiens [sequence omitted]

SEQ ID NO: 1032279 - protein, 248 aa, Homo sapiens; identical to SEQ ID NO: 738779

SEQ ID NO: 1032280 - protein, 248 aa, Homo sapiens [sequence omitted]

SEQ ID NO: 1032281 - protein, 394 aa, Homo sapiens
MRKALSSLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWETGPGRSCRWLRRSQEMFAKGTEITHACCNQETEMRSYRHEARRELIVLPRLSCCQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTYRGGLPIYLLRIWTATTSFDYQGHQRQVTR

SEQ ID NO: 1032282 - protein, 121 aa, Homo sapiens
LPLPPSGNWAVNEGLSIFVILVWLGLNVFLFVWYYRVYDIPPKFFYTRKLLGSALALARAPAACLNFNCMLILLPVCRNLLSFLRGSSALSPGASLKSQGIDVLRASLRAALSQSWMAVGG

SEQ ID NO: 1032283 - protein, 97 aa, Homo sapiens
GIMVMLIGPAKYNLLHDPPHFQIYFYWLCRDTHAFEWFADLLQLLESQMQERNNAGFLSYNIYLTGWDESQVRTRLQGSGPSHSVQGLRTSPWLLCL

SEQ ID NO: 1032284 - protein, 364 aa, Homo sapiens
PSMELNELYVGLDLHFSPRRIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 1032285 - protein, 570 aa, Homo sapiens
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 1032286 - protein, 133 aa, Homo sapiens
LPLPPSGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSGKFIKENLEPGSSLYS

SEQ ID NO: 1032287 - protein, 280 aa, Homo sapiens
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEGLGAPNPWERLKGREQGGPQSGRRAKGGPKNGANTRGADPTRGPPTLRNAPPYSQEAAPQKRPTATEQGQCTVPPHG

SEQ ID NO: 1032288 - protein, 354 aa, Homo sapiens
MNGLLSNSRRIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 1032289 - protein, 371 aa, Homo sapiens
KYMQNLLIKQFNFLLLNDLDLHFSPRRIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 1032290 - protein, 570 aa, Homo sapiens; identical to SEQ ID NO: 1032285

SEQ ID NO: 1032291 - protein, 506 aa, Homo sapiens
MLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 1032292 - protein, 617 aa, Homo sapiens
LPLPPSGNWAVNEGLSIFVILVWLGLNVFLFVWYYRVYDIPPKFFYTRKLLGSALALARAPAACLNFNCMLILLPVCRNLLSFLRGSSALSPGASLKSQGIDVLRASLRAALSQSWMAVGGVNTQSFLTRLCCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 1032293 - protein, 570 aa, Homo sapiens; identical to SEQ ID NO: 1032285

SEQ ID NO: 1032294 - protein, 142 aa, Homo sapiens
HPIQAIGVKKQSPRRYLLRWGGGGSRSSPGRRGGRARGGGRDQNGLSKGGGGGYNSYGGYGGGGGGGYNAYGGGGGGSSYGGSNYGNGFGGFGSYSQHQSSYGPMKSGGGGGGGGSSWGGRSNSGPYRGGYGGGGGYGGSSF

SEQ ID NO: 1032295 - protein, 152 aa, Homo sapiens
MSSFLQPGHADCLFGPIVRPAQIVSHPVHGHTLHIVDAVLQDGLPLSAINLLAANEVAGGVGKVDEAGLSVEVQGSGVHEVFNGDHVLIRDLAPISMPRMMPGRPLPYTRNSSCSGFLHDFPSLPRLKPERQRQVLRLVAVGQQADVNRITR

SEQ ID NO: 1032296 - protein, 187 aa, Homo sapiens
MAEGWGLITVVQAIVVSVTLPALLDAAAVGTGKLAWLALGWRHVGWVRQASDAVCVQHLVLSTGALAAPRGGQAQAAAAAIVHPAFVGANLLLLGIIHSDLKDGGPLTAQKGHSGGCASYTPFPAVDTATPILSPEEVVAMVTQAKGVVQLRTFIHNLPVCAIEQYRLDAVVEGIHPVEAPSRDVQA

SEQ ID NO: 1032297 - protein, 187 aa, Homo sapiens; identical to SEQ ID NO: 1032296

SEQ ID NO: 1032298 - protein, 1012 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1032299 - protein, 1041 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGVSADPSPHSCIPDLLPYSFPPNIFLPSSQRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1032300 - protein, 949 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLRPTEPLPQLQLLRMPPTLSVPCGTSLAQPSTPCSGPGMEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1032301 - protein, 883 aa, Homo sapiens
MEVPGTHPGDSCYTPTPQICAGSCTQISEASWTAVWYLGILWWCCAGWQQGQAFPPRLLLPLLWNRVDGGWLEGFESGVELRLGLLMPTESYQQVDAETVVGLARDLEPLKRTEEEPLEEPLDEALVRTVALSSAGVLSPMVAMLGAVAAQEVLKVGRGIGVGGTGKMWRSVCVSEGTQLLESSPGAFTNLGEASSQDLRGGQEVAGVPSLKCCPQAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGVSADPSPHSCIPDLLPYSFPPNIFLPSSQRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1032302 - protein, 275 aa, Homo sapiens [sequence omitted]

SEQ ID NO: 1032303 - protein, 1122 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGVPSPWSLTPTKTHTSSTYWQLPTCMPRCMGCLAHRTGLHSGSCCSCCHSLTPEVAKNLVLMGVGSLTLHDPHPTCWSDLAAQFLLSEQDLERSRAEASQELLAQLNRAVQVVVHTGDITEDLLL

SEQ ID NO: 1032304 - protein, 1102 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKVGRGIGVGGTGKMWRSVCVSEGTQLLESSPGAFTNLGEASSQDLRGGQEVAGVPSLKCCPQAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGVSADPSPHSCIPDLLPYSFPPNIFLPSSQRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1032305 - protein, 987 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1032306 - protein, 302 aa, Homo sapiens [sequence omitted]

SEQ ID NO: 1032307 - protein, 214 aa, Homo sapiens
ALSEAAGALLWVSSGSTTPSSPTLTTGPCDGSSVSLCGPHSPISCAGPGLDGEGAETLGPDPTSPPPPTPWLLFPASPALPLGKAAGNWDGGWGEEEVSDSSSTSSQFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1032308 - protein, 739 aa, Homo sapiens
MASILLRSCRGRAPARLPPPPRYTVPRGSPGDPAHLSCASTLGLRNCLNVPFGCCTPIHPVYTSSRGDHLGCWALRPECLRIVSRAPWTSTSVGFVAVGPQCLPVRGWHSSRPVRDDSVVEKSLKSLKDKNKKLEEGGPVYSPPAEVVVKKSLGQRVLDELKHYYHGFRLLWIDTKIAARMLWRILNGHSLTRRERRQFLRICADLFRLVPFLVFVVVPFMEFLLPVAVKLFPNMLPSTFETQSLKEERLKKELRVKLELAKFLQDTIEEMALKNKAAKGSATKDFSVFFQKIRETGERPSNEEIMRFSKLFEDELTLDNLTRPQLVALCKLLELQSIGTNNFLRFQLTMRLRSIKADDKLIAEEGVDSLNVKELQAACRARGMRALGVTEDRLRGQLKQWLDLHLHQEIPTSLLILSRAMYLPDTLSPADQLKSTLQTLPEIVAKEAQVKVAEVEGEQVDNKAKLEATLQEEAAIQQEHREKELQKRSEVAKDFEPERVVAAPQRPGTEPQPEMPDTVLQSETLKDTAPVLEGLKEEEITKEEIDILSDACSKLQEQKKSLTKEKEELELLKEDVQDYSEDLQEIKKELSKTGEEKYVEESKASKRLTKRVQQMIGQIDGLISQLEMDQQAGKLAPANGMPTGENVISVAELINAMKQVKHIPESKLTSLAAALDENKDGKVNIDDLVKVIELVDKEDVHISTSQVAEIVATLEKEEKVEEKEKAKEKAEKEVAEVKS

SEQ ID NO: 1032309 - protein, 297 aa, Homo sapiens
DAWVDPRRASYPTRCGPRRPGPTLSATLQEEAAIQQEHREKELQKRSEVAKDFEPERVVAAPQRPGTEPQPEMPDTVLQSETLKDTAPVLEGLKEEEITKEEIDILSDACSKLQEQKKSLTKEKEELELLKEDVQDYSEDLQEIKKELSKTGEEKYVEESKASKRLTKRVQQMIGQIDGLISQLEMDQQAGKLAPANGMPTGENVISVAELINAMKQVKHIPESKLTSLAAALDENKDGKVNIDDLVKVIELVDKEDVHISTSQVAEIVATLEKEEKVEEKEKAKEKAEKEVAEVKS

SEQ ID NO: 1032310 - protein, 254 aa, Homo sapiens
MRHTWPFRNVPFGCCTPIHPVYTSSRGDHLGCWALRPECLRIVSRAPWTSTSVGFVAVGPQCLPVRGWHSSRPVRDDSVVEKSLKSLKDKNKKLEEGGPVYSPPAEVVVKKSLGQRVLDELKHYYHGFRLLWIDTKIAARMLWRILNGHSLTRRERRQFLRICADLFRLVPFLVFVVVPFMEFLLPVAVKLFPNMLPSTFETQSLKEERLKKELRVKLELAKFLQDTIEEMALKNKAAKGSATKDFSVFFQKVL

SEQ ID NO: 1032311 - protein, 739 aa, Homo sapiens; identical to SEQ ID NO: 1032308

SEQ ID NO: 1032312 - protein, 85 aa, Homo sapiens
MPSVTQRLRDPDINPCLSESDASTRCLDENNYDRERCSTYFLRYKNCRRFWNSIVMQRRKNGVKPFMPTAAERDEILRAVGNMPY

SEQ ID NO: 1032313 - protein, 158 aa, Homo sapiens
MDVFGAGDGLGAGEAEAGVNTRGTHAKEGTFGNPNLECLVFRIRKEKEMKCEETHAPNSNWVYVMLPSKKTVRMPSVTQRLRDPDINPCLSESDASTRCLDENNYDRERCSTYFLRYKNCRRFWNSIVMQRRKNGVKPFMPTAAERDEILRAVGNMPY

SEQ ID NO: 1032314 - protein, 85 aa, Homo sapiens; identical to SEQ ID NO: 1032312

SEQ ID NO: 1032315 - protein, 158 aa, Homo sapiens; identical to SEQ ID NO: 1032313

SEQ ID NO: 1032316 - protein, 128 aa, Homo sapiens
MDVFGAGDGLGAGEAEAGVNTRGTHAKEGTFGNPNLECLVFRIRKEKEMKCEETHAPNSNWESDASTRCLDENNYDRERCSTYFLRYKNCRRFWNSIVMQRRKNGVKPFMPTAAERDEILRAVGNMPY

SEQ ID NO: 1032317 - protein, 85 aa, Homo sapiens; identical to SEQ ID NO: 1032312

SEQ ID NO: 1032318 - protein, 117 aa, Homo sapiens
RATLVLVLGLEIWMDDNQGFSQPQLREGALVARAPQPCNGGIFLFYFFVGDRLECSGAISVRCNLCFPGSSDSPASASQVAGITGTHHHARLILVFKVEHRVSLMWARLSLNSVTSG

SEQ ID NO: 1032319 - protein, 117 aa, Homo sapiens; identical to SEQ ID NO: 1032318

SEQ ID NO: 1032320 - protein, 117 aa, Homo sapiens; identical to SEQ ID NO: 1032318

SEQ ID NO: 1032321 - protein, 117 aa, Homo sapiens; identical to SEQ ID NO: 1032318

SEQ ID NO: 1032322 - protein, 117 aa, Homo sapiens; identical to SEQ ID NO: 1032318

SEQ ID NO: 1032323 - protein, 327 aa, Homo sapiens
MVSTTSWLYLPGWFFFLLFFLFLDGDNAAEPPALVTFLAIPSAVVTGRASSSSTDMVARGLVAGGARKPGGRAGKRKARGRGGAGGLGARGGSRRERPRPGLGPGGRAGVGAGPGRSEGWGARSRGRTRGPSWGSETESEPAAGAGDVDLGRAGAKRNPAERETPPPQLPLAPLELAGRARCASGGRALLSAFYSFMADHVENNNSLVRGQRQLVLLGAPSPAAGFSDRASPAPPRPQRGAPDRAWAPGAVERRLASWKGSAKANGEVHPRLRERERRGAPRLEANSAGPRGGPTAGSLAAGSPENATGTRALSRPGGLQACPQEEL

SEQ ID NO: 1032324 - protein, 81 aa, Homo sapiens
MVSTTSWLYLPGWFFFLLFFLFLDGDNAAEPPALVTFLAIPSAVVTGRASSSSTDMVARGLVAGGARKPGGRLLPFLPPAA

SEQ ID NO: 1032325 - protein, 327 aa, Homo sapiens; identical to SEQ ID NO: 1032323

SEQ ID NO: 1032326 - protein, 327 aa, Homo sapiens; identical to SEQ ID NO: 1032323

SEQ ID NO: 1032327 - protein, 102 aa, Homo sapiens
MGWEQETQKSRPWNQVEGRQPGHDPEQDTCSTSPFAMSKSSLRPPKKLMPCASCTAAEPDGFPWLCYSHSWKCCLTESSGHPGRMDVVVPPTLQMGKLRLES

SEQ ID NO: 1032328 - protein, 327 aa, Homo sapiens; identical to SEQ ID NO: 1032323

SEQ ID NO: 1032329 - protein, 327 aa, Homo sapiens; identical to SEQ ID NO: 1032323

SEQ ID NO: 1032330 - protein, 327 aa, Homo sapiens; identical to SEQ ID NO: 1032323

SEQ ID NO: 1032331 - protein, 327 aa, Homo sapiens
MVSTTSWLYLPGWFFFLLFFLFLDGDNAAEPPALVTFLAIPSAVVTGRASSSSTDMVARGLVAGGARKPGGRAGKRKARGRGGAGGLGARGGSRRERPRPGLGPGGRAGVGAGPGRSEGWGARSRGRTRGPSWGSETESEPAAGAGDVDLGRAGAKRNPAERETPPPQLPLAPLELAGRARCASGGRALLSAFYSFMADHVENNNSLVRGQRQLVLLGAPSPAAGFSDRASPAPPRPQRGAPDRARAPGAVERRLASWKGSAKANGEVHPRLRERERRGAPRLEANSAGPRGGPTAGSLAAGSPENATGTRALSRPGGLQACPQEEL

SEQ ID NO: 1032332 - protein, 327 aa, Homo sapiens; identical to SEQ ID NO: 1032323

SEQ ID NO: 1032333 - protein, 327 aa, Homo sapiens; identical to SEQ ID NO: 1032323

SEQ ID NO: 1032334 - protein, 137 aa, Homo sapiens
MALLSQEGLAEWTVSRAQDNVEGLRPHLLEEGPCEFPDRERGWVSESTTQLSLPKLHSCFQARLAAWRRERNSQLCVLGPLIRVLRTRSLLRMCRGDSGERNMVATAGVTAVYRDGMGAGNPKEPALEPGGGEAARP

SEQ ID NO: 1032335 - protein, 327 aa, Homo sapiens; identical to SEQ ID NO: 1032331

SEQ ID NO: 1032336 - protein, 327 aa, Homo sapiens; identical to SEQ ID NO: 1032331

SEQ ID NO: 1032337 - protein, 327 aa, Homo sapiens; identical to SEQ ID NO: 1032323

SEQ ID NO: 1032338 - protein, 327 aa, Homo sapiens; identical to SEQ ID NO: 1032323

SEQ ID NO: 1032339 - protein, 114 aa, Homo sapiens
APPLSVPGVCCFFLKGLNALLCPKKGPWNEGKSRAALSPERLFVAHPKARRVGSWERMRGLRVPRAASNHDDGRCQGREPIEASPGLFQKPKANNEKRYIVGGGERLRGPGAPP

SEQ ID NO: 1032340 - protein, 185 aa, Homo sapiens
MVKLGNNFAEKGTKQPLLEDGFDTIPLMTPLDVNQLQFPPPDKVVVKTKTEYEPDRKKGKARPPQIAEFTVSITEGVTERFKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 1032341 - protein, 185 aa, Homo sapiens; identical to SEQ ID NO: 1032340

SEQ ID NO: 1032342 - protein, 185 aa, Homo sapiens; identical to SEQ ID NO: 1032340

SEQ ID NO: 1032343 - protein, 185 aa, Homo sapiens; identical to SEQ ID NO: 1032340

SEQ ID NO: 1032344 - protein, 185 aa, Homo sapiens; identical to SEQ ID NO: 1032340

SEQ ID NO: 1032345 - protein, 185 aa, Homo sapiens; identical to SEQ ID NO: 1032340

SEQ ID NO: 1032346 - protein, 185 aa, Homo sapiens; identical to SEQ ID NO: 1032340

SEQ ID NO: 1032347 - protein, 130 aa, Homo sapiens
MSISCSSRPQIAEFTVSITEGVTERFKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 1032348 - protein, 141 aa, Homo sapiens
MVKLGNNFAEKGTKQPLLEDGFDTIPLMTPLDVNQLQFPPPDKVVVKTKTEYEPDRKKGKARPPQIAEFTVSITEGVTERFKVSVLVLFALAFLTCVVFLVVYKVYKYDRACPDGFVLKNTQCIPEEKLSEQETEAAEKSA

SEQ ID NO: 1032349 - protein, 185 aa, Homo sapiens; identical to SEQ ID NO: 1032340

SEQ ID NO: 1032350 - protein, 185 aa, Homo sapiens; identical to SEQ ID NO: 1032340

SEQ ID NO: 1032351 - protein, 185 aa, Homo sapiens; identical to SEQ ID NO: 1032340

SEQ ID NO: 1032352 - protein, 81 aa, Homo sapiens
KPCACPKWNCPGNNNNDIFTPGRQVPKLSSIPHVGAGNAFPVTDVLMPFKLHIGVPVYSSWRSEAQAREKQARSSVAHFFL

SEQ ID NO: 1032353 - protein, 92 aa, Homo sapiens
MAISINIIFPVFQKKISQFANVRNHFAGPAGEVALWAGGSGGTASSNGCHRPRRPPATPSDRCSASSRSLTLARNSSVISTAIATRTLSPTL

SEQ ID NO: 1032354 - protein, 185 aa, Homo sapiens; identical to SEQ ID NO: 1032340

SEQ ID NO: 1032355 - protein, 185 aa, Homo sapiens; identical to SEQ ID NO: 1032340

SEQ ID NO: 1032356 - protein, 185 aa, Homo sapiens; identical to SEQ ID NO: 1032340

SEQ ID NO: 1032357 - protein, 185 aa, Homo sapiens; identical to SEQ ID NO: 1032340

SEQ ID NO: 1032358 - protein, 185 aa, Homo sapiens; identical to SEQ ID NO: 1032340

SEQ ID NO: 1032359 - protein, 185 aa, Homo sapiens; identical to SEQ ID NO: 1032340

SEQ ID NO: 1032360 - protein, 185 aa, Homo sapiens; identical to SEQ ID NO: 1032340

SEQ ID NO: 1032361 - protein, 119 aa, Homo sapiens
MVKLGNNFAEKGTKQPLLEDGFDTIPLMTPLDVNQLQFPPLRSPCWSSSPWPSSPASSSWLSTRCTSMTAPAPMGSSSRTPSASQKRSCPSRRLKRLRSQLSGMGKFLTMCHLQITKGL

SEQ ID NO: 1032362 - protein, 185 aa, Homo sapiens; identical to SEQ ID NO: 1032340

SEQ ID NO: 1032363 - protein, 185 aa, Homo sapiens; identical to SEQ ID NO: 1032340

SEQ ID NO: 1032364 - protein, 92 aa, Homo sapiens; identical to SEQ ID NO: 1032353

SEQ ID NO: 1032365 - protein, 171 aa, Homo sapiens
MENSQLCKLFIGGLNVQTSESGLRGHFEAFGTLTDCVVVVNPQTKRSRCFGFVTYSNVEEADAAMAASPHAVNGLSKGGGGGYNSYGGYGGGGGGGYNAYGGGGGGSSYGGSDYGNGFGGFGSYSQHQSSYGPMKSGGGGGGGGSSWGGRSNSGPYRGGYGGGGGYGGSSF

SEQ ID NO: 1032366 - protein, 247 aa, Homo sapiens
MENSQLCKLFIGGLNVQTSESGLRGHFEAFGTLTDCVVVVNPQTKRSRCFGFVTYSNVEEADAAMAASPHAVDGNTVELKRAVSREDSARPGAHAKVKKLFVGGLKGDVAEGDLIEHFSQFGTVEKAEIIADKQSGKKRGFGFVYFQNHDAADKAAVVKFHPIQGHRVEVKKAVPKEDIYSGGGGGGSRSSRGEGGAPGETDASGRAGHSTGRAGGGESQEGGAPGGARSGAKTKAWQRGGARASKG

SEQ ID NO: 1032367 - protein, 82 aa, Homo sapiens
MRVSAAHRTVPNVAGRAGAETARPLGTDTPPMAGGEPASTGGTPRHAEGEADPRGGITRARRRAGPTPKGRRTTRPAAKALT

SEQ ID NO: 1032368 - protein, 305 aa, Homo sapiens; identical to SEQ ID NO: 767307

SEQ ID NO: 1032369 - protein, 305 aa, Homo sapiens; identical to SEQ ID NO: 767307

SEQ ID NO: 1032370 - protein, 305 aa, Homo sapiens; identical to SEQ ID NO: 767307

SEQ ID NO: 1032371 - protein, 67 aa, Homo sapiens
TRRGRVGRPTRRENRVLLAMVNPTVFFDIAVDGEPLGRVSFELFADKVPKTAGKFSCSEHWRERIWL

SEQ ID NO: 1032372 - protein, 66 aa, Homo sapiens
LVRGWVRIGRGENRVLLAMVNPTVFFDIAVDGEPLGRVSFELFADKVPKTAGKFSCSEHWRERIWL

SEQ ID NO: 1032373 - protein, 103 aa, Homo sapiens
NFRLGTRLGLNRPRLGILSHGKCWTPTQMGSPVFHLHCPRLKWLDGKHVVFGKVNRRHEYCGGHGALWVPGMARPARRSPLLTVDNSNKFDLCFILTTRSFLL

SEQ ID NO: 1032374 - protein, 165 aa, Homo sapiens; identical to SEQ ID NO: 879533

SEQ ID NO: 1032375 - protein, 165 aa, Homo sapiens; identical to SEQ ID NO: 879533

SEQ ID NO: 1032376 - protein, 165 aa, Homo sapiens; identical to SEQ ID NO: 879533

SEQ ID NO: 1032377 - protein, 165 aa, Homo sapiens; identical to SEQ ID NO: 879533

SEQ ID NO: 1032378 - protein, 165 aa, Homo sapiens; identical to SEQ ID NO: 879533

SEQ ID NO: 1032379 - protein, 165 aa, Homo sapiens; identical to SEQ ID NO: 879533

SEQ ID NO: 1032380 - protein, 69 aa, Homo sapiens
YGRYEAGVESDEAEENRVLLAMVNPTVFFDIAVDGEPLGRVSFELFADKVPKTAGKFSCSEHWRERIWL

SEQ ID NO: 1032381 - protein, 69 aa, Homo sapiens; identical to SEQ ID NO: 1032380

SEQ ID NO: 1032382 - protein, 69 aa, Homo sapiens; identical to SEQ ID NO: 1032380

SEQ ID NO: 1032383 - protein, 69 aa, Homo sapiens; identical to SEQ ID NO: 1032380

SEQ ID NO: 1032384 - protein, 69 aa, Homo sapiens; identical to SEQ ID NO: 1032380

SEQ ID NO: 1032385 - protein, 69 aa, Homo sapiens; identical to SEQ ID NO: 1032380

SEQ ID NO: 1032386 - protein, 69 aa, Homo sapiens; identical to SEQ ID NO: 1032380

SEQ ID NO: 1032387 - protein, 69 aa, Homo sapiens; identical to SEQ ID NO: 1032380

SEQ ID NO: 1032388 - protein, 69 aa, Homo sapiens; identical to SEQ ID NO: 1032380

SEQ ID NO: 1032389 - protein, 69 aa, Homo sapiens; identical to SEQ ID NO: 1032380

SEQ ID NO: 1032390 - protein, 69 aa, Homo sapiens; identical to SEQ ID NO: 1032380

SEQ ID NO: 1032391 - protein, 84 aa, Homo sapiens
GFFVWQTPPPENRVLLAMVNPTVFFDIAVDGEPLGRVSFELFADKVPKTAGFTELFQGLCVRVVTSHAIMALVASPSMGRNFER

SEQ ID NO: 1032392 - protein, 69 aa, Homo sapiens; identical to SEQ ID NO: 1032380

SEQ ID NO: 1032393 - protein, 86 aa, Homo sapiens
VLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 1032394 - protein, 69 aa, Homo sapiens; identical to SEQ ID NO: 1032380

SEQ ID NO: 1032395 - protein, 69 aa, Homo sapiens; identical to SEQ ID NO: 1032380

SEQ ID NO: 1032396 - protein, 86 aa, Homo sapiens; identical to SEQ ID NO: 1032393

SEQ ID NO: 1032397 - protein, 69 aa, Homo sapiens; identical to SEQ ID NO: 1032380

SEQ ID NO: 1032398 - protein, 69 aa, Homo sapiens; identical to SEQ ID NO: 1032380

SEQ ID NO: 1032399 - protein, 69 aa, Homo sapiens; identical to SEQ ID NO: 1032380

SEQ ID NO: 1032400 - protein, 86 aa, Homo sapiens; identical to SEQ ID NO: 1032393

SEQ ID NO: 1032401 - protein, 68 aa, Homo sapiens
GNDLRLGTRPGWRENRVLLAMVNPTVFFDIAVDGEPLGRVSFELFADKVPKTAGKFSCSEHWRERIWL

SEQ ID NO: 1032402 - protein, 69 aa, Homo sapiens; identical to SEQ ID NO: 1032380

SEQ ID NO: 1032403 - protein, 69 aa, Homo sapiens; identical to SEQ ID NO: 1032380

SEQ ID NO: 1032404 - protein, 69 aa, Homo sapiens; identical to SEQ ID NO: 1032380

SEQ ID NO: 1032405 - protein, 69 aa, Homo sapiens; identical to SEQ ID NO: 1032380

SEQ ID NO: 1032406 - protein, 69 aa, Homo sapiens; identical to SEQ ID NO: 1032380

SEQ ID NO: 1032407 - protein, 69 aa, Homo sapiens; identical to SEQ ID NO: 1032380

SEQ ID NO: 1032408 - protein, 69 aa, Homo sapiens; identical to SEQ ID NO: 1032380

SEQ ID NO: 1032409 - protein, 69 aa, Homo sapiens; identical to SEQ ID NO: 1032380

SEQ ID NO: 1032410 - protein, 69 aa, Homo sapiens; identical to SEQ ID NO: 1032380

SEQ ID NO: 1032411 - protein, 103 aa, Homo sapiens
MVSLTCYRYAYSLLPLTTCYGTSSTKLSHIGTWVTERFCKKCQMIVRDASDYWIISGLEVHRRSLLVITTMNIHSPRLCVRVVTSHAIMALVASPSMGRNFER

SEQ ID NO: 1032412 - protein, 69 aa, Homo sapiens; identical to SEQ ID NO: 1032380

SEQ ID NO: 1032413 - protein, 86 aa, Homo sapiens; identical to SEQ ID NO: 1032393

SEQ ID NO: 1032414 - protein, 72 aa, Homo sapiens
TRRGRVGRPTRRCLQTRSQRQQENFRALSTGEKGFGYKGSCFHRIIPGFMCQGGDFTRHNGTGGKSIYGEKF

SEQ ID NO: 1032415 - protein, 69 aa, Homo sapiens; identical to SEQ ID NO: 1032380

SEQ ID NO: 1032416 - protein, 69 aa, Homo sapiens; identical to SEQ ID NO: 1032380

SEQ ID NO: 1032417 - protein, 69 aa, Homo sapiens; identical to SEQ ID NO: 1032380

SEQ ID NO: 1032418 - protein, 86 aa, Homo sapiens; identical to SEQ ID NO: 1032393

SEQ ID NO: 1032419 - protein, 165 aa, Homo sapiens; identical to SEQ ID NO: 879533

SEQ ID NO: 1032420 - protein, 165 aa, Homo sapiens; identical to SEQ ID NO: 879533

SEQ ID NO: 1032421 - protein, 165 aa, Homo sapiens; identical to SEQ ID NO: 879533

SEQ ID NO: 1032422 - protein, 165 aa, Homo sapiens; identical to SEQ ID NO: 879533

SEQ ID NO: 1032423 - protein, 165 aa, Homo sapiens; identical to SEQ ID NO: 879533

SEQ ID NO: 1032424 - protein, 254 aa, Homo sapiens
SAAVVGVLPASLVFPSCGFGRGNEHGSPACHCLPPASSEASLCPAAQVTFRKTLEKEAKGEEPDIAVPKFKQRKGESDGAYIHRMQQEAQHVLFLSKNQAIRQPEVQAAPKEKSEQKKAKKAWWRREGEGSALGAGGKTLGSHDGPLQVPCFIAMGQPGFRETKPEPWELASRSIQLGASEGVASRRLRNLGTLRRPRLVLAFTGKAPESPSPVGISPEGVGLRVTCPGVLFPLEQNVSRPRDYTFLIYVPNSC

SEQ ID NO: 1032425 - protein, 301 aa, Homo sapiens
GSGFSREPPGVEMAGAGRGAAVSRVQAGPGSPRRARGRQQVQPLGKQRPAPWPGLRSKEKKKVNCKPKNQDEQEIPFRLREIMRSRQEMKNPISNKKRKKAAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRKKPEPQL

SEQ ID NO: 1032426 - protein, 225 aa, Homo sapiens
SVEAAAAAAARGATPPHFPEEARAAAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRKKPEPQL

SEQ ID NO: 1032427 - protein, 245 aa, Homo sapiens
SAAVVGVLPASLVFPSCGFGRGNEHGSPACHCLPPASSEASLCPAAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRKKPEPQL

SEQ ID NO: 1032428 - protein, 301 aa, Homo sapiens; identical to SEQ ID NO: 1032425

SEQ ID NO: 1032429 - protein, 310 aa, Homo sapiens
GSGFSREPPGVEMAGAGRGAAVSRVQAGPGSPRRARGRQQVQPLGKQRPAPWPGLRSKEKKKVNCKPKNQDEQEIPFRLREIMRSRQEMKNPISNKKRKKAAQVTFRKTLEKEAKGEEPDIAVPKFKQRKGESDGAYIHRMQQEAQHVLFLSKNQAIRQPEVQAAPKEKSEQKKAKKASVEAGGGGVCPGSRREDMGSHDGPLQVPCFIAMGQPGFRETKPEPWELASRSIQLGASEGVASRRLRNLGTLRRPRLVLAFTGKAPESPSPVGISPEGVGLRVTCPGVLFPLEQNVSRPRDYTFLIYVPNSC

SEQ ID NO: 1032430 - protein, 301 aa, Homo sapiens; identical to SEQ ID NO: 1032425

SEQ ID NO: 1032431 - protein, 338 aa, Homo sapiens
AEVASLGSLPAWRWRELVAEQRCPGCRRVLGVPGERGGGSKCSRWGSSAQPRGPGFAGDLRCPAEAATLPQRRGRLEGSARDPLGSVRSDPFPSKEKKKVNCKPKNQDEQEIPFRLREIMRSRQEMKNPISNKKRKKAAQVTFRKTLEKEAKGEEPDIAVPKFKQRKGESDGAYIHRMQQEAQHVLFLSKNQAIRQPEVQAAPKEKSEQKKAKKAFQKRRLDKVRRKKEEKAADRLEQELLRDTVKFGEVVLQPPELTARPQRSVSKDQPGRRSQMLRMLLSPGGVSQPLTASLARQRIVEEERERAVQAYRALKQRQQQLHGERPHLTSRKKPEPQL

SEQ ID NO: 1032432 - protein, 131 aa, Homo sapiens [sequence omitted]

SEQ ID NO: 1032433 - protein, 301 aa, Homo sapiens; identical to SEQ ID NO: 1032425

SEQ ID NO: 1032434 - protein, 550 aa, Homo sapiens
AAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 1032435 - protein, 461 aa, Homo sapiens
MRRLVHDLLPPEVCSLLNPAAIYANNEISLRDVEVYGFDYDYTLAQYADALHPEIFSTARDILIEHYKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 1032436 - protein, 550 aa, Homo sapiens; identical to SEQ ID NO: 1032434

SEQ ID NO: 1032437 - protein, 550 aa, Homo sapiens; identical to SEQ ID NO: 1032434

SEQ ID NO: 1032438 - protein, 418 aa, Homo sapiens
AERGWLGATVKLPPHHPSCLPGAPKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 1032439 - protein, 550 aa, Homo sapiens; identical to SEQ ID NO: 1032434

SEQ ID NO: 1032440 - protein, 478 aa, Homo sapiens
AAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLDERAAGAEVHHQGPVQCAVRQHLPHLPQPHLLLKAPRALL

SEQ ID NO: 1032441 - protein, 550 aa, Homo sapiens; identical to SEQ ID NO: 1032434

SEQ ID NO: 1032442 - protein, 270 aa, Homo sapiens
TEAGGNLAFAQLPNVLGVRTPLAGMGPLEQVGLYGGGMGVARPVPGHRLEVMPFYLHPRPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 1032443 - protein, 563 aa, Homo sapiens
MPPQPPKSSDHKGRWWPGGGKRQPVSPGSAGQCTWHLSARAVAGPSSGPQVVPTPPDTAVHRLRSLRGTHSAVCSGRCSSSWQCSAAAPAVAICAGVAGPAAPAITLVVGQAGTSDHCSYLATVGVLTAATMPVLAQVCHCTHAAIPFIAQAALTAVACTAHSLGCTGWGTHRLQLQLHLTAWPSPAFITEAGARAPKALITAAMHSAAAGLTMGPKGTRSTEFTGCPSNNLNGTDTAHCHSCRPCTRHGHYKGCWAAKGKLALTAIVTRAAAGLPGGGDYNCGGSPCPGLGAYPKGWGGPRRCVIPKSAAEGTSRTSGRSASRPQGCPAPVTPQDRVAPAHRCCRCSVAGAGSQSGHSEHQGQVAPAAGRCHRPGHPQKGKCRCTMRASSSPTMSSPGRVRLQEKEMGVPCMVRSGPRLGRSDAKASTLRIMWPRRMAAELVTVVLMVQPGLAIRRQSSKGGVCGPQHCEGPMGCLSKQGQEAGHLQEAAEDLVTEALGGGGDISPRDGSIIRLPVQRLGGQQDTVNEVQDAVHGLMVAAHHAREVIEVYAALPLAEAQWVP

SEQ ID NO: 1032444 - protein, 177 aa, Homo sapiens
MRASSSPTMSSPGRVRLQEKEMGVPCMVRSGPRLGRSDAKASTLRIMWPRRMAAELVTVVLMVQPGLAIRRQSSKGGVCGPQHCEGPMGCLSKQGQEAGHLQEAAEDLVTEALGGGGDISPRDGSIIRLPVQRLGGQQDTVNEVQDAVHGLMVAAHHAREVIEVYAALPLAEAQWVP

SEQ ID NO: 1032445 - protein, 177 aa, Homo sapiens; identical to SEQ ID NO: 1032444

SEQ ID NO: 1032446 - protein, 510 aa, Homo sapiens
AAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELSCLLNYRVDFTFYPRRTPLQHEAPLWMDQLCTGCMKTPFLGDMAHIR

SEQ ID NO: 1032447 - protein, 177 aa, Homo sapiens; identical to SEQ ID NO: 1032444

SEQ ID NO: 1032448 - protein, 520 aa, Homo sapiens
MRVESGSAQERGILLESLSTLLEKTTASHEGRAPGNRELTDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 1032449 - protein, 418 aa, Homo sapiens; identical to SEQ ID NO: 1032438

SEQ ID NO: 1032450 - protein, 550 aa, Homo sapiens; identical to SEQ ID NO: 1032434

SEQ ID NO: 1032451 - protein, 550 aa, Homo sapiens; identical to SEQ ID NO: 1032434

SEQ ID NO: 1032452 - protein, 367 aa, Homo sapiens
HSAAMEQRPRHRTSSRADVPFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 1032453 - protein, 550 aa, Homo sapiens; identical to SEQ ID NO: 1032434

SEQ ID NO: 1032454 - protein, 237 aa, Homo sapiens
SCSVPLSRKWEQQRADVRRERRRIRKRYPDFVGRLPTKWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 1032455 - protein, 177 aa, Homo sapiens; identical to SEQ ID NO: 1032444

SEQ ID NO: 1032456 - protein, 177 aa, Homo sapiens; identical to SEQ ID NO: 1032444

SEQ ID NO: 1032457 - protein, 94 aa, Homo sapiens
GRSALAAVRRPRRAASRLVLALLPWVRPPGSRRPLPRRPALRARPGTHQRRRPQRAPMGSLPGHAETGARPPAPRGLQSPEPSSHLRQQRDQPA

SEQ ID NO: 1032458 - protein, 461 aa, Homo sapiens; identical to SEQ ID NO: 1032435

SEQ ID NO: 1032459 - protein, 117 aa, Homo sapiens
AIPQPDLTKLHQCGNATVSFSHEAGNTDPVQGWDASAQTTSHELTIPNDLIGCIIGRQGAKINEIRQMSGAQIKIANPVEGSTDRQVTITGSAASISLAQYLINVRLSSETGGMGSS

SEQ ID NO: 1032460 - protein, 117 aa, Homo sapiens; identical to SEQ ID NO: 1032459

SEQ ID NO: 1032461 - protein, 117 aa, Homo sapiens; identical to SEQ ID NO: 1032459

SEQ ID NO: 1032462 - protein, 117 aa, Homo sapiens; identical to SEQ ID NO: 1032459

SEQ ID NO: 1032463 - protein, 117 aa, Homo sapiens; identical to SEQ ID NO: 1032459

SEQ ID NO: 1032464 - protein, 117 aa, Homo sapiens; identical to SEQ ID NO: 1032459

SEQ ID NO: 1032465 - protein, 107 aa, Homo sapiens
MPFSIEARVHSVNSTLSTISTSTLARHLGISWLGFTAPSKCPPLDFVFVFSVWVSRTHVALKGRTHSLKSVHPTASVMPSLIFQLLHARSSLVTSCYNVTLGLGHLS

SEQ ID NO: 1032466 - protein, 104 aa, Homo sapiens
MPFSIEARVHSVNSTLSTISTSTLARHLGISWLGFTAPSKCPPLDFVFVFSVWVSRTHVALKGRTHSLKSVHPTASVMPSLIFQLLHARSSLVTSWTLGLGHLP

SEQ ID NO: 1032467 - protein, 104 aa, Homo sapiens; identical to SEQ ID NO: 1032466

SEQ ID NO: 1032468 - protein, 104 aa, Homo sapiens; identical to SEQ ID NO: 1032466

SEQ ID NO: 1032469 - protein, 126 aa, Homo sapiens
MSDHFTFLPHGELTHWGLFFPLEKCGYWKFPLFRKNRIGGALWGVLLPSSLLKASWCSGSTSDTRRRFSFILRPHSISATQISSGSGASTFRGSSSNDSSDSSHHSIFLFQQKDLCGGLGSTPGAE

SEQ ID NO: 1032470 - protein, 104 aa, Homo sapiens; identical to SEQ ID NO: 1032466

SEQ ID NO: 1032471 - protein, 237 aa, Homo sapiens
MHLNPSRITKYGEEFIETWKEPKETGEPQVFLASRAEKGPWEMLDLEDPQGIEGFPGPPGLPGAMIPGQTGNRGPPGSRGSQGALGPPGPPGSHVIGIIRRQRVYGPPWAQKVHLELQETWDHQVSLGAPGTPGLPGPRGDPGFQGFPGVKGEKGNPGFLGFIGPPGPIGPKGPPGVRGDPGTLKIISLPGSPGPPGTPGEPGMQGEPGPPGPPGNLGVGLAALTWITEEVVEPKYL

SEQ ID NO: 1032472 - protein, 503 aa, Homo sapiens
MHLNPSRITKYGEEFIETWKEPKETGEPQVFLASRAEKGPWEMLDLEDPQGIEGFPGPPGLPGAMIPGQTGNRGPPGSRGSQGALGPPGPPGSHVIGIIRRQRVYGPPWAQKVHLELQETWDHQVSLGAPGTPGLPGPRGDPGFQGFPGVKGEKGNPGFLGFIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 1032473 - protein, 470 aa, Homo sapiens
MHLNPSRITKYGEEFIETWKEPKETGEPQVFLASRAEKGPWEMLDLEDPQGIEGFPGPPGLPGAMIPGQTGNRGPPGSRGSQGALGPPGPPGSHVIGIIRRQRVYGPPWAQKVHLELQETWDHQVSLGAPGTPGLPGPRGDPGFQGFPGVKGEKGNPGFLGFIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMKAYSINCESWGIRKNNKSLSGVHEEKTLKLKKTAELVFFILKNKVMTEHAVI

SEQ ID NO: 1032474 - protein, 152 aa, Homo sapiens
YKINVQKSQAFLYTNNRQTESQIMSELPFTIASKRIKYLGIQLTREVKDLFKENYKPLLNEIKEDTNKWKNIPCSCIGRINIMKMAILPKVIYRFNAIPIKLPMTFFTELEKTTLKFIWNQKRTSIPTQITRILLMKCALYPHSINVGAYLM

SEQ ID NO: 1032475 - protein, 503 aa, Homo sapiens; identical to SEQ ID NO: 1032472

SEQ ID NO: 1032476 - protein, 331 aa, Homo sapiens
MHLNPSRITKYGEEFIETWKEPKETGEPQVFLASRAEKGPWEMLDLEDPQGIEGFPGPPGLPGAMIPGQTGNRGPPGSRGSQGALGPPGPPGSHVIGIIRRQRVYGPPWAQKVHLELQETWDHQVSLGAPGTPGLPGPRGDPGFQGFPGVKGEKGNPGFLGFIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLDALFVKVLRSP

SEQ ID NO: 1032477 - protein, 301 aa, Homo sapiens
MPGISSQILTNAQGQVIGTLPWVVNSASVAAPAPAQSLQVQAVTPQLLLNAQGQVIATLASSPLPPPVAVRKPSTPESPAKSEVQPIQPTPTVPQPAVVIASPAPAAKPSASAPIPITCSETPTVSQLVSKPHTPSLDEDGINLEEIREFAKNFKIRRLSLGLTQTQVGQALTATEGPAYSQSAICRFEKLDITPKSAQKLKPVLEKWLNEAELRNQEGQQNLMEFVGGEPSKKRKRRTSFTPQAIEALNAYFEKNPLPTGQEITEIAKELNYDREVVRVWFCNRRQTLKNTSKLNVFQIP

SEQ ID NO: 1032478 - protein, 352 aa, Homo sapiens
PSQWTPPPQITVQPAAFAFSPGIISAASLGGQTQILGSLTTAPVITSAIPSMPGISSQILTNAQGQVIGTLPWVVNSASVAAPAPAQSLQVQAVTPQLLLNAQGQVIATLASSPLPPPVAVRKPSTPESPAKSEVQPIQPTPTVPQPAVVIASPAPAAKPSASAPIPITCSETPTVSQLVSKPHTPSLDEDGINLEEIREFAKNFKIRRLSLGLTQTQVGQALTATEGPAYSQSAICRFEKLDITPKSAQKLKPVLEKWLNEAELRNQEGQQNLMEFVGGEPSKKRKRRTSFTPQAIEALNAYFEKNPLPTGQEITEIAKELNYDREVVRVWFCNRRQTLKNTSKLNVFQIP

SEQ ID NO: 1032479 - protein, 353 aa, Homo sapiens
GTLTDHGETAARYLAQESLFLHPQISAASLGGQTQILGSLTTAPVITSAIPSMPGISSQILTNAQGQVIGTLPWVVNSASVAAPAPAQSLQVQAVTPQLLLNAQGQVIATLASSPLPPPVAVRKPSTPESPAKSEVQPIQPTPTVPQPAVVIASPAPAAKPSASAPIPITCSETPTVSQLVSKPHTPSLDEDGINLEEIREFAKNFKIRRLSLGLTQTQVGQALTATEGPAYSQSAICRFEKLDITPKSAQKLKPVLEKWLNEAELRNQEGQQNLMEFVGGEPSKKRKRRTSFTPQAIEALNAYFEKNPLPTGQEITEIAKELNYDREVVRVWFCNRRQTLKNTSKLNVFQIP

SEQ ID NO: 1032480 - protein, 352 aa, Homo sapiens; identical to SEQ ID NO: 1032478

SEQ ID NO: 1032481 - protein, 184 aa, Homo sapiens
GTLTDHGETAARYLAQESLFLHPQISAASLGGQTQILGSLTTAPVITSAIPSMPGISSQILTNAQGQVIGTLPWVVNSASVAAPAPAQSLQVQAVTPQLLLNAQGQVIATLASSPLPPPVAVRKPSTPESPAKSEVQPIQPTPTVPQPAVVIASPAPAAKPSASAPIQLRSALFPKCPARGPNS

SEQ ID NO: 1032482 - protein, 196 aa, Homo sapiens [sequence omitted]

SEQ ID NO: 1032483 - protein, 99 aa, Homo sapiens
RREREREREREREREREREKNTLARRKGRHMGIGKRKGTANARMPEKVTWMRRMRILRRLLRRYRESKKIDRHMYHSLYLKVKGNVFKTSGFSWNTSTS

SEQ ID NO: 1032484 - protein, 232 aa, Homo sapiens
MAKFFPFISGMSAIAFHTQRLGPESNSAKRALVNQGSNILPLVFCNFSREYNHPLWASPRDRGARSHNGDTKLYITGKYGINTPHCVPHRCPKRKGSHHVNEEEEIVGSFCPPASVSPRKEYSAENLYKKDIRFLPHNEYFTTAVYTVKGDKGEMLVSQRTIARIFHWRTHNPPQGCKEHKTQGLRHKKLLADQAEARRSKTKEARKRREERLQAKKEEIIKTLSKEEETQK

SEQ ID NO: 1032485 - protein, 98 aa, Homo sapiens
EPGNSAIMAGKLFPFAAAAAAMSMLRLQKRLASSVLRCGKKKVWLDPNETNEIANANSRQQIRKLIKDGLIIRKPVTVHSRARCRVQPMPECQRRSHG

SEQ ID NO: 1032486 - protein, 96 aa, Homo sapiens
EPGNSAIMAGKLFPFAAAAAAMSMLRLQKRLASSVLRCGKKKVWLDPNETNEIANANSRQQIRKLIKDGLIIRKPVTVHSRARCRKHLAPEGKTMA

SEQ ID NO: 1032487 - protein, 98 aa, Homo sapiens; identical to SEQ ID NO: 1032485

SEQ ID NO: 1032488 - protein, 95 aa, Homo sapiens
ELRTPQIRHRESKKRSPHVSQPVPEGEGECVQNKRILMEHIHKLKADKARKKLLADQAEARRSKTKEARKRREERLQAKKEEIIKTLSKEEETQK

SEQ ID NO: 1032489 - protein, 115 aa, Homo sapiens
EPGNSAIMAGKLFPFAAAAAAMSMLRLQKRLASSVLRCGKKKVWLDPNETNEIANANSRQQIRKLIKDGLIIRKPVTVHSRARCRKNTLARRKGRHMGIGKRKATPIPNSERYMD

SEQ ID NO: 1032490 - protein, 117 aa, Homo sapiens
EPGNSAIMAGKLFPFAAAAAAMSMLRLQKRLASSVLRCGKKKVWLDPNETNEIANANSRQQIRKLIKDGLIIRKPVTVHSRARCREKHLWARRKGQGTLGIRYSGKGVTGQIAPKLP

SEQ ID NO: 1032491 - protein, 196 aa, Homo sapiens [sequence omitted]

SEQ ID NO: 1032492 - protein, 196 aa, Homo sapiens
VRFFVRPLCFVLFSLFSPSLFFLACLALVSSFSSLCLVFVFSLALLLFSLFLALSFSLFSFSCFVLFVSVLSVRVFSPLAVVSLQSVVLVLSFFLPCPLGFVAPFAALLSFAIFFFFFCLACTRVSCALFSSWWWLSLCCFMFVAVSYLVFDLGRSGARLLLRVKFSFVDVIIATDGLDKCEPVPSSLRGKLFVEN

SEQ ID NO: 1032493 - protein, 650 aa, Homo sapiens
QPHLRQPHPRLGAVSGSGPGVGGGAAGGRRSSSAAAAAAAHAWGGAAGAAGPELPPGARAEGRRRARRCCLLVALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSLGYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 1032494 - protein, 611 aa, Homo sapiens
QPHLRQPHPRLGAVSGSGPGVGGGAAGPPCCLLVALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSLGYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 1032495 - protein, 451 aa, Homo sapiens
QPHLRQPHPRLGAVSGSGPGVGGGAAGGRRSSSAAAAAAAHAWGGAAGAAGPELPPGARAEGRRRARRCCLLVALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSLGYPTLRIEKNDLRSVTLLEAKGKVKDIAISRERITLKDVLQEGTFGRIFHGILIDEKDPNKEKQAFVKTVKDQASEIQVTMMLTESCKLRGLHHRQFLSKTWYTWLFRLPVE

SEQ ID NO: 1032496 - protein, 352 aa, Homo sapiens
QPHLRQPHPRLGAVSGSGPGVGGGAAGGRRSSSAAAAAAAHAWGGAAGAAGPELPPGARAEGRRRARRCCLLVALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPHYHSLHLLSVSSYRAAHRESCMP

SEQ ID NO: 1032497 - protein, 127 aa, Homo sapiens
AETLGLSSGSKAQQQAITANNVIRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 1032498 - protein, 607 aa, Homo sapiens [sequence omitted]

SEQ ID NO: 1032499 - protein, 108 aa, Homo sapiens
EDLGKKIALALNKVDGANVALKDSDQVAQSDGEESPAAEEQLLGEHIKEEKEESEFLPSSGGTFNISVSGDIDRQQLNFRGRAVCRPVLDPNLRDKVMFEARISTILG

SEQ ID NO: 1032500 - protein, 522 aa, Homo sapiens
CPGWLPCGLKPDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032501 - protein, 754 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHVRIAPTVTTWSNKTPTALPSHPPAASPSDNTGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032502 - protein, 723 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032503 - protein, 708 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032504 - protein, 721 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTENQSIQDQAPMLEGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032505 - protein, 745 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGRALHYRRIRLPKSSPAQHQASSPTSSPATSFPPPPSSGASFQHGGPGAPPSSSAYALPPGTTGTLPAASELPASQRTENQSIQDQAPMLEGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032506 - protein, 434 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQHPSSMADQELHHHLQLMHCLLEQQVLRMVGMTLQL

SEQ ID NO: 1032507 - protein, 377 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHVRIAPTVTTWSNKTPTALPSHPPAASPSDTQEKILHLRVS

SEQ ID NO: 1032508 - protein, 567 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTENQSIQDQAPMLEGPQNGWNDPPALNRVPKKKKMPEPPVTNAAATAFSSSTTVKPVFIPTATSSRWPALPWRTATSWSNRHATIFFKAQY

SEQ ID NO: 1032509 - protein, 723 aa, Homo sapiens; identical to SEQ ID NO: 1032502

SEQ ID NO: 1032510 - protein, 227 aa, Homo sapiens
VNHIERDNITKQGGALQPRNFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032511 - protein, 730 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTRSLLFQLSPTITRGLLHNIARSIETRNYSEGLTMHTHIVSTSNFSETSAFMPVLKVVLTQANKLGV

SEQ ID NO: 1032512 - protein, 716 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTENQSIQDQAPMLEGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGYHCRAESNYRRCCYPLLPQSWTCFCVQVCPP

SEQ ID NO: 1032513 - protein, 605 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQVTVNL

SEQ ID NO: 1032514 - protein, 67 aa, Homo sapiens
RLYEDPPASMLIRSTAPGLFTYLQPCYFFPSSPFLWSILPAWRTRSSTIIFSLCTASWNNRYTACCQ

SEQ ID NO: 1032515 - protein, 723 aa, Homo sapiens; identical to SEQ ID NO: 1032502

SEQ ID NO: 1032516 - protein, 736 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTENQSIQDQAPMLEGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032517 - protein, 723 aa, Homo sapiens; identical to SEQ ID NO: 1032502

SEQ ID NO: 1032518 - protein, 716 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032519 - protein, 355 aa, Homo sapiens
PPVPKDTAGLVDKAVAVDKVVPGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032520 - protein, 385 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRSSEWLE

SEQ ID NO: 1032521 - protein, 318 aa, Homo sapiens
DSMRIRRLYDDPPASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 1032522 - protein, 211 aa, Homo sapiens [sequence omitted]

SEQ ID NO: 1032523 - protein, 699 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPLSPTITSGLHNIARSIETRNYSEGLTMHTHIVSTSNFSETSAFMPVLKVVLTQANKLGV

SEQ ID NO: 1032524 - protein, 385 aa, Homo sapiens; identical to SEQ ID NO: 1032520

SEQ ID NO: 1032525 - protein, 417 aa, Homo sapiens
EDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQPCCFLVLHTLYDVGTELD

SEQ ID NO: 1032526 - protein, 245 aa, Homo sapiens; identical to SEQ ID NO: 886778

SEQ ID NO: 1032527 - protein, 118 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLLKSFFSPVFSVLS

SEQ ID NO: 1032528 - protein, 245 aa, Homo sapiens; identical to SEQ ID NO: 886778

SEQ ID NO: 1032529 - protein, 187 aa, Homo sapiens; identical to SEQ ID NO: 886790

SEQ ID NO: 1032530 - protein, 245 aa, Homo sapiens; identical to SEQ ID NO: 886778

SEQ ID NO: 1032531 - protein, 193 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGQSKQVWRYLG

SEQ ID NO: 1032532 - protein, 245 aa, Homo sapiens; identical to SEQ ID NO: 886778

SEQ ID NO: 1032533 - protein, 245 aa, Homo sapiens; identical to SEQ ID NO: 886778

SEQ ID NO: 1032534 - protein, 187 aa, Homo sapiens; identical to SEQ ID NO: 886790

SEQ ID NO: 1032535 - protein, 224 aa, Homo sapiens
MPLVPRWCPTLLSSQPSVSLMTFLGTETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVPGHMLSGKSLDLPLAYST

SEQ ID NO: 1032536 - protein, 456 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVPGHMLSGKSLDLPLAYST

SEQ ID NO: 1032537 - protein, 481 aa, Homo sapiens
LPGFILNGCTSRGWPPPLPPAQSEIMKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVPGHMLSGKSLDLPLAYST

SEQ ID NO: 1032538 - protein, 443 aa, Homo sapiens
MKVVNLKQAILQAWKERWSDYQWAINMKKFFPKGATWDILNLADALLEQAMIGPSPNPLILSYLKYAISSQFDDFFRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVPGHMLSGKSLDLPLAYST

SEQ ID NO: 1032539 - protein, 475 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASLHTSQGLGQGGTRANQPTASWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVPGHMLSGKSLDLPLAYST

SEQ ID NO: 1032540 - protein, 456 aa, Homo sapiens; identical to SEQ ID NO: 1032536

SEQ ID NO: 1032541 - protein, 479 aa, Homo sapiens
AYVDQRRWIVRWPPPLPPAQSEIMKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVPGHMLSGKSLDLPLAYST

SEQ ID NO: 1032542 - protein, 371 aa, Homo sapiens
MTFLRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVPGHMLSGKSLDLPLAYST

SEQ ID NO: 1032543 - protein, 277 aa, Homo sapiens
AGSRGAAARLGAGRGAQDPKWGSRSQRANSCPPSSMASCAEPSEPSAPLPAGVPPLEDFEVLDGVSSSSPANSLALAKQPGALAREFLAAMEPEPAPAPAPEEWLDILGNGLLRKKNAGPRAARFEPPGQGPGGHLYICRRRWRIGTLGAGGAGAGVHSVVTVTSSRPWISVSHSLDVGETAMVTADSKYCYGPQGSRSPYIPPHAALCLEVTLKTAVDGPDLEMLTGQERVALANRKRECGNPTYQRADFVLAANSYDLAIKAITSSAKVDMTFEE

SEQ ID NO: 1032544 - protein, 301 aa, Homo sapiens
AGSRGAAARLGAGRGAQDPKWGSRSQRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKNAGPRAARFEPPGQGPGGHLYICRRRWRIGTLGAGGAGAGVHSVVTVTSSRPWISVSHSLDVGETAMVTADSKYCYGPQGSRSPYIPPHAALCLEVTLKTAVDGPDLEMLTGQERVALANRKRECGNPTYQRADFVLAANSYDLAIKAITSSAKVDMTFEE

SEQ ID NO: 1032545 - protein, 476 aa, Homo sapiens
GLIARRVDRPKSAPRAAPSRATARAGPSRAEPQPSRAGPSAPVPAAMPAGRARTCALLALCLLGPQDFGPTRFICTSVPVDADMCAASVAAGGAEELRSSNVLQLRETVLQQKETILSQKETIRELTAKLGRCESQSTLDPGAGEARAGGGRKQPGSGKNTMGDLSRTPAAETLSQLGQTLQSLKTRLENLEQYSRLNSSSQTNSLKDLLQSKIDELERQVLSRVNTLEEGKGGPRNDTEERVKIETALTSLHQRISELEKGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 1032546 - protein, 476 aa, Homo sapiens; identical to SEQ ID NO: 1032545

SEQ ID NO: 1032547 - protein, 476 aa, Homo sapiens; identical to SEQ ID NO: 1032545

SEQ ID NO: 1032548 - protein, 430 aa, Homo sapiens
MPAGRARTCALLALCLLGPQDFGPTRFICTSVPVDADMCAASVAAGGAEELRSSNVLQLRETVLQQKETILSQKETIRELTAKLGRCESQSTLDPGAGEARAGGGRKQPGSGKNTMGDLSRTPAAETLSQLGQTLQSLKTRLENLEQYSRLNSSSQTNSLKDLLQSKIDELERQVLSRVNTLEEGKGGPKNDTEERVKIETALTSLHQRISELEKGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 1032549 - protein, 233 aa, Homo sapiens
MLQCLCFPGLAPPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032550 - protein, 909 aa, Homo sapiens
SWYGSGFLDRRSRRRAAGASHSDGPARTMAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032551 - protein, 909 aa, Homo sapiens; identical to SEQ ID NO: 1032550

SEQ ID NO: 1032552 - protein, 866 aa, Homo sapiens
SWYGSGFLDRRSRRRAAGASHSDGPARTMAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISESTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032553 - protein, 773 aa, Homo sapiens
PTRSRTRGSTHASGHASANAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032554 - protein, 254 aa, Homo sapiens
MPASFPMLRCARSPCWTVCWSPWCRALPDGRCSCLSSPPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032555 - protein, 956 aa, Homo sapiens
SWYGSGFLDRRSRRRAAGASHSDGPARTMAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSVMFFKPIYGSVTKIQKSHKGANCELHSAGTRGGRQLLLTPKPQHRSSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032556 - protein, 80 aa, Homo sapiens
PPATSQVGSCEWWVPQRYPVTSPGPGVGPELCLLHLQTLLREVQTLRDRLCTEDEASSCATAQRLLQVYRQLRHPSLILL

SEQ ID NO: 1032557 - protein, 774 aa, Homo sapiens
SWYGSGFLDRRSRRRAAGASHSDGPARTMAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGAPRYPCHTVHTCPAAHSGTPR

SEQ ID NO: 1032558 - protein, 249 aa, Homo sapiens
MAGGSFQQRLRCGWGREKHCPWGGGSLSGGGSTPTVCWSWSQARCLPGLSQDVAPGAVGVPPLPGVMSVLRRVSFLKKAVDQRNKALTSLNEAMNVSCALLSSGTGPRPISCTTSTTWSRLQTQDVLMATCVLENSSSFSPAPSLLPQPGLRPTSWCWCFHLGRVLAPLPLQALSAMSAGRSREVLLCCDKRPCLSVNLQASAVFSRPFPPSLTGLLPEPGAAWEPSPPGWPPRKTRPCDPVTPEEALL

SEQ ID NO: 1032559 - protein, 730 aa, Homo sapiens
MQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032560 - protein, 792 aa, Homo sapiens
GPSTGVLWSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032561 - protein, 485 aa, Homo sapiens
MAGGSFQQRLRCGWGREKHCPWGGGSLSGGGSTPTVCWSWSQARCLPGLSQDVAPGAVGVPPLPGVMSVLRRVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQAAQGSSAPDLRVQYLRQIHANHETLLREVQTLRDRLCTEDEASSCATAQRLLQVYRQLRHPSLILL

SEQ ID NO: 1032562 - protein, 909 aa, Homo sapiens; identical to SEQ ID NO: 1032550

SEQ ID NO: 1032563 - protein, 766 aa, Homo sapiens
SWYGSGFLDRRSRRRAAGASHSDGPARTMAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASSAGVSPSLTAAAAPALAFLTAGQPSHHRSSP

SEQ ID NO: 1032564 - protein, 792 aa, Homo sapiens
SWYGSGFLDRRSRRRAAGASHSDGPARTMAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLALPHTRAPSPLGPTRDPVATFLETCREPGSQPAGPASLRAEYLPPSVASIKVSAELLRAALKDGHSGWWHCLALLSLGDFFFFFKRQELALLPRLECSGAIMAHCS

SEQ ID NO: 1032565 - protein, 903 aa, Homo sapiens [sequence omitted]

SEQ ID NO: 1032566 - protein, 980 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELSPGPQSAPFRPQPLSHVVEPKLGTVKSCSLDGSVLLYMGPSPFQNIRCPTFPFVALFSSQVSASLKALSHFFSLGFRRLAREQARVCELQSGNQQLEEQRVELVERLQAMLQAHWDEANQLLSTTLPPPNPQAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032567 - protein, 946 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKTYSVLGTQASWLQPTPPLEELESLVLWSYQRWATPRLLTLFPSHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPQAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032568 - protein, 401 aa, Homo sapiens
YKTPGVFKHSTCQLTYYTGSIPRYADVPCVAVLTLSVPPLCTQRVELVERLQAMLQAHWDEANQLLSTTLPPPNPQAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032569 - protein, 579 aa, Homo sapiens
MIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELSPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGYKPGRKEEGFSGWKLDYGEWSGCVLH

SEQ ID NO: 1032570 - protein, 903 aa, Homo sapiens [sequence omitted]

SEQ ID NO: 1032571 - protein, 761 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVHPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032572 - protein, 864 aa, Homo sapiens [sequence omitted]

SEQ ID NO: 1032573 - protein, 774 aa, Homo sapiens
LGSFAHVGDLEPQGACFRILLILPLQTYSVLGTQASWLQPTPPLEELESLVLWSYQRWATPRLLTLFPSHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPQAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032574 - protein, 388 aa, Homo sapiens
MASLYVAKPGSNCQPQTVLPKCWDYRCEPLHPEIYNLIKVFVPCLISLNLLCFDPSFCLSPGQAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032575 - protein, 843 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELSPGPQSAPFRPQPLSHVVEPKLGTVKSCSLDGSVLLYMGPSPFQNIRCPTFPFVALFSSQVSASLKALSHFFSLGFRRLAREQARVCELQSGNQQLEEQRVELVERLQAMLQAHWDEANQLLSEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032576 - protein, 851 aa, Homo sapiens
PGVGESGQRKQAGKPLSKRFQEKSLPFFGRGGEGVRELEREGLFSSGGPCFCHYLTLALGSLWLPAGDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPQAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 1032577 - protein, 591 aa, Homo sapiens
MDDFRDPQRWKECAKQGKMPCYFDLIEENVYLTERKKNKSHRDIKRMQCECTPLSKDKELKGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKNERSRRGFKVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKGWQEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTRNQPE

SEQ ID NO: 1032578 - protein, 773 aa, Homo sapiens
MENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAGDGPGELQHMDENPMKASKKPKTAEADNPSGTGKERPAFPKKARSRPRVNYGTAGCGIPG

SEQ ID NO: 1032579 - protein, 375 aa, Homo sapiens
MEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAV

SEQ ID NO: 1032580 - protein, 1833 aa, Homo sapiens
NGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVPKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKLLRAARSLLTSPADHVSPFLNSISNFVLKKNENLRAFCEETGRWLGSWMMHEKYNRRYIEFQRKVKLKRKTQQLNEEGMLLASEIKHLPRRLLIGQERETQTSKLKIKRKGNEEAPSHHPLLPMSGEQKGQMTDDDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAGDGPGELQHMDENPMKASKKPKTAEADNFQWNWQRKAGVSKESPVSPARELWNCWMWDSR

SEQ ID NO: 1032581 - protein, 591 aa, Homo sapiens; identical to SEQ ID NO: 1032577

SEQ ID NO: 1032582 - protein, 1778 aa, Homo sapiens
NGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVPKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAGDGPGELQHMDENPMKASKKPKDSRSRQLPVELDKERPAFPKKARSRPRVNYGTAGCGIPG

SEQ ID NO: 1032583 - protein, 355 aa, Homo sapiens
MQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAGDGPGELQHMDENPMKASKKPKTAEADNFQWNWPRKAGVSKESPVSPARELWNCWMWDSR

SEQ ID NO: 1032584 - protein, 204 aa, Homo sapiens [sequence omitted]

SEQ ID NO: 1032585 - protein, 204 aa, Homo sapiens [sequence omitted]

SEQ ID NO: 1032586 - protein, 186 aa, Homo sapiens; identical to SEQ ID NO: 919972

SEQ ID NO: 1032587 - protein, 117 aa, Homo sapiens
ETEKGRGKATKEKNFLEATWAHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYR

SEQ ID NO: 1032588 - protein, 204 aa, Homo sapiens [sequence omitted]

SEQ ID NO: 1032589 - protein, 204 aa, Homo sapiens [sequence omitted]

SEQ ID NO: 1032590 - protein, 105 aa, Homo sapiens
GRVGRPTRRHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYR

SEQ ID NO: 1032591 - protein, 204 aa, Homo sapiens [sequence omitted]

SEQ ID NO: 1032592 - protein, 204 aa, Homo sapiens [sequence omitted]

SEQ ID NO: 1032593 - protein, 228 aa, Homo sapiens
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHKHREMRGLTSAGRKSRGLGKGHKFHHTIGGSRRAAWRRRNTLQLHRYFSMAGEALENLYIMVEEEANMSFFT

SEQ ID NO: 1032594 - protein, 78 aa, Homo sapiens
AAAAMEPRSMEYFCAQVQQKDVGGRLQVGQELLLYLGAPGAISDLEEDLGRLGKTVDALTGWVGSSNYRCLALPAGVQ

SEQ ID NO: 1032595 - protein, 771 aa, Homo sapiens
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESYPNDLQFNILMRFTVDQTQTPSLKVKVAILKYIETLAKQ

SEQ ID NO: 1032596 - protein, 779 aa, Homo sapiens
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESYPNDLQFNILMRFTVDQTQTPSLKVKVAILKYIETLAKQ

SEQ ID NO: 1032597 - protein, 653 aa, Homo sapiens
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLR

SEQ ID NO: 1032598 - protein, 456 aa, Homo sapiens
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGRVRAKLSAPLAGMGNAKADSRGRSRTKMVSQSQRMYCLSALLYLSLC

SEQ ID NO: 1032599 - protein, 428 aa, Homo sapiens
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGIGVHT

SEQ ID NO: 1032600 - protein, 244 aa, Homo sapiens
AAAAMEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARQGLALLPRLQCSVTISAYCNLHLPG

SEQ ID NO: 1032601 - protein, 785 aa, Homo sapiens
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESYPNDLQFNILMRFTVDQTQTPSLKVKVAILKYIETLAKQ

SEQ ID NO: 1032602 - protein, 1008 aa, Homo sapiens
AAAAMEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESYPNDLQFNILMRFTVDQTQTPSLKVKVAILKYIETLAKQ

SEQ ID NO: 1032603 - protein, 833 aa, Homo sapiens
GREEKEKCRHKPQWWFCGCFCLFLIESLISIEFTVFGHVNYWEPPRVREIKSFQRNEATDLQTGSVIDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLTNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESYPNDLQFNILMRFTVDQTQTPSLKVKVAILKYIETLAKQ

SEQ ID NO: 1032604 - protein, 471 aa, Homo sapiens
LNFPQNSVVFYWFLSEECEIVFLLKAFFILCSRPFSSKWSTANPSTVAGRVSAGSSKASSLPGSLQRSRSDIDVNAAAGAKAHHAAGQSVRSGRLGAGALNAGSYASLGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESYPNDLQFNILMRFTVDQTQTPSLKVKVAILKYIETLAKQ

SEQ ID NO: 1032605 - protein, 143 aa, Homo sapiens
KVVIKDPPPPRVPAPKEEEEEPLPTKKWPPVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEGRCINFSRVPSQ

SEQ ID NO: 1032606 - protein, 143 aa, Homo sapiens; identical to SEQ ID NO: 1032605

SEQ ID NO: 1032607 - protein, 143 aa, Homo sapiens; identical to SEQ ID NO: 1032605

SEQ ID NO: 1032608 - protein, 143 aa, Homo sapiens; identical to SEQ ID NO: 1032605

SEQ ID NO: 1032609 - protein, 144 aa, Homo sapiens
KVVIKDPPPPRVPAPKEEEEEPLPTKKWPPVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEVCIWECIEKELTA

SEQ ID NO: 1032610 - protein, 106 aa, Homo sapiens
MSAEVVESGKTVWVSLSLPGGLKTKGPVHKLLPSSISVKGKQEDQEGTKMAHFHIADFQPNEKNQVHFRSFWKSSLIPLSREMFSLPSALLAPNISKHLFCHLHGR

SEQ ID NO: 1032611 - protein, 143 aa, Homo sapiens; identical to SEQ ID NO: 1032605

SEQ ID NO: 1032612 - protein, 389 aa, Homo sapiens
RHEGQLLELAARPGRLRERVLELARGGGDPYSDLSKGVLICWTVQDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 1032613 - protein, 355 aa, Homo sapiens
MLDASTVLDFGVLASIMQSGHTRIPVYEEERSNIVDMLYLKDLAFVDPEDCTPLSTITRFYNHPLHFVFNDTKLDAVLEEFKRGDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPSLPLLPRGRDSAAYSDSDLFGLSHLVSAVTAFVWP

SEQ ID NO: 1032614 - protein, 389 aa, Homo sapiens; identical to SEQ ID NO: 1032612

SEQ ID NO: 1032615 - protein, 389 aa, Homo sapiens; identical to SEQ ID NO: 1032612

SEQ ID NO: 1032616 - protein, 288 aa, Homo sapiens
MLAHCNLRLLGSSDSPASASQVAGITGVTPHLAPAKFSCVEVLGAAAHRPPGRSLVGTITLNCLQCWVWFHWPLGPSGHCPFFPPRAEVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 1032617 - protein, 239 aa, Homo sapiens
MAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 1032618 - protein, 121 aa, Homo sapiens
MAPLKRKEEFSLFKVSDDEYKVTISPQLLLATQRFLSREVDVFSPLRISEKVLLHLLKHPSVNQEVRFDESNRLATHHYLYQRSQPVDYFILILQVAVGPRPGVPPASSRPREGSRRRGEG

SEQ ID NO: 1032619 - protein, 239 aa, Homo sapiens; identical to SEQ ID NO: 1032617

SEQ ID NO: 1032620 - protein, 335 aa, Homo sapiens
MLAHCNLRLLGSSDSPASASQVAGITGVYHHAQLIFVFLVEAGFCHIGQAGLQLLTAGDPPASASESVGIKAVSHDRTWPLPEFSCVEVLGAAAHRPPGRSLVGTITLNCLQCWVWFHWPLGPSGHCPFFPPRAEVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 1032621 - protein, 103 aa, Homo sapiens
MLKVVPLSSSGTVSPFLPTFCISLHQLGPSNAVILQVTRLQYLNALLATRAQNLPQSPENTDLQVIPGSQTRLLGEKTTTAAGSSHSRPGVPVEGSPGRNPGV

SEQ ID NO: 1032622 - protein, 83 aa, Homo sapiens
LTVARVQDVTCSSACLWLILGLGYQAQSQEKDNDPNQTDEEVFHFLGLGYQDSPIQDAILHLELLLSFFLTLYFEIISDDRKL

SEQ ID NO: 1032623 - protein, 354 aa, Homo sapiens
MCGRTSCHLPRDVLTRACAYQDRRGQQRLPEWRDPDKYCPSYNKSPQSNSPVLLSRLHFDKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 1032624 - protein, 354 aa, Homo sapiens
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 1032625 - protein, 371 aa, Homo sapiens
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSRGCCSGWPQRHPKRKTQKHLKRKSQMFPSGPVSSCRRVHSPPKRGTAGLLEQWLKREKEDGTCGQASLQPVTQDFQRPRPGSAALLF

SEQ ID NO: 1032626 - protein, 264 aa, Homo sapiens
MCGRTSCHLPRDVLTRACAYQDRRGQQRLPEWRDPDKYCPSYNKSPQSNSPVLLSRLHFEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 1032627 - protein, 34 aa, Homo sapiens
MGDKKTAVNAVESPVWTPGVDHERKCCTCVYLKK

SEQ ID NO: 1032628 - protein, 354 aa, Homo sapiens; identical to SEQ ID NO: 1032624

SEQ ID NO: 1032629 - protein, 354 aa, Homo sapiens; identical to SEQ ID NO: 1032624

SEQ ID NO: 1032630 - protein, 179 aa, Homo sapiens [sequence omitted]

SEQ ID NO: 1032631 - protein, 181 aa, Homo sapiens
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWGHSQKLSQAAGRKQLPR

SEQ ID NO: 1032632 - protein, 371 aa, Homo sapiens; identical to SEQ ID NO: 1032625

SEQ ID NO: 1032633 - protein, 371 aa, Homo sapiens; identical to SEQ ID NO: 1032625

SEQ ID NO: 1032634 - protein, 371 aa, Homo sapiens; identical to SEQ ID NO: 1032625

SEQ ID NO: 1032635 - protein, 371 aa, Homo sapiens; identical to SEQ ID NO: 1032625

SEQ ID NO: 1032636 - protein, 295 aa, Homo sapiens
MFSRELAPTRIGGASSGSRSGGTLISTAPLTTRVLNPTAQCFCLDCTLRKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 1032637 - protein, 142 aa, Homo sapiens [sequence omitted]

SEQ ID NO: 1032638 - protein, 109 aa, Homo sapiens
PLRHSDLKKSVRHGCNISFHSQVYQIVSAPDAKSPLLQESLFATEVRMAAAEHRHSSGLPYWPYLTAETLKNRMGHQPPPPTQQHSITDNSLSLKTPSECVLYPHHCAR

SEQ ID NO: 1032639 - protein, 221 aa, Homo sapiens
STRRGDNIKTPAFHPQRMISRHLPSVSSLPFHPQLHPQQMIISRYLLSVCGFRFHHQPFHPQRMIISRHLPSVSSLPFHPQLHPQQMIISRHLPSVCGGRFHPQRMIISRHLPSVSSLPLPPRRRAGQAHLPRLRRMIIYKTAFRGVSVTRHFTPLQTHKTVRQMIEKSTTPGQTRICGEAGFQPLEADGQSSENTIPRRQRDTSHIATRSSLTSPSRQNR

SEQ ID NO: 1032640 - protein, 109 aa, Homo sapiens
MIISRQLAERLRRRAGQAHLPRLRRMIIYKTAFRGVSVTRHFTPLQTHKTVQTDDRVVNDTWPDADLRGGRLPTARGGWTIVREHHSETSEGHIPHCNPLEPYQPVKTE

SEQ ID NO: 1032641 - protein, 163 aa, Homo sapiens
TCGFSIVILQSRLAPASVQTLSSCSSPQLYPQLHPQQMIISRHVPSVCSIPFHPQRMIISRHHVSSLPFHPQLHPQQMIISRHLPSVCGGRAPPSADDSFSRHLPSVSSVPFQPQLQPLPMILSRVLPSVCGGRFHPQRMIFSRHLPSVSSLPFHPQLLPLPI

SEQ ID NO: 1032642 - protein, 72 aa, Homo sapiens
MRSRGVPSVRDFVPPSADDNLKTPSERQLTPLPPSAPPSADDNIKTPAERLRGRFHPERMIISQRDPLSHLS

SEQ ID NO: 1032643 - protein, 256 aa, Homo sapiens
MAAAEHRHSSGLPYWPYLTAETLKNRMGHQPPPPTQQHSITDNSLSLKTPPECLLIPLPPSADDNLKTPSERQLTPLPPSAPPSADDNIKTPAERLRGPLPPSADDNLKTPSERQLTPLPPSAPPSADDNIKTPAERLQLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTSPSTLSSTLSR

SEQ ID NO: 1032644 - protein, 256 aa, Homo sapiens; identical to SEQ ID NO: 1032643

SEQ ID NO: 1032645 - protein, 256 aa, Homo sapiens; identical to SEQ ID NO: 1032643

SEQ ID NO: 1032646 - protein, 256 aa, Homo sapiens; identical to SEQ ID NO: 1032643

SEQ ID NO: 1032647 - protein, 256 aa, Homo sapiens; identical to SEQ ID NO: 1032643

SEQ ID NO: 1032648 - protein, 129 aa, Homo sapiens
MHTKKRVSSFRGNKIGLKDVITLRRHVETKVRAKIRKRKVTTKINHHDKINGKRKTAKEHLRKLSMKEREHGEKERQVSEAEENGKLDMKEIHTYMEMFQRAQALRRRAEDYYRCKITPSARKPLCNRG

SEQ ID NO: 1032649 - protein, 425 aa, Homo sapiens
MAAAEHRHSSGLPYWPYLTAETLKNRMGHQPPPPTQQHSITDNSLSLKTPPECLLIPLPPSADDNLKTPSERQLTPLPPSAPPSADDNIKTPAERLRGPLPPSADDNLKTPSERQLTPLPPSAPPSADDNIKTPAERLQLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTSPSTLPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPTPLPPSADDNLKTPPECVLTPLPPSADDNLKTPSECVLTPLPPSASRVAGITGACHHAWLIFCIFSREGVSPY

SEQ ID NO: 1032650 - protein, 129 aa, Homo sapiens; identical to SEQ ID NO: 1032648

SEQ ID NO: 1032651 - protein, 129 aa, Homo sapiens; identical to SEQ ID NO: 1032648

SEQ ID NO: 1032652 - protein, 129 aa, Homo sapiens; identical to SEQ ID NO: 1032648

SEQ ID NO: 1032653 - protein, 129 aa, Homo sapiens; identical to SEQ ID NO: 1032648

SEQ ID NO: 1032654 - protein, 129 aa, Homo sapiens; identical to SEQ ID NO: 1032648

SEQ ID NO: 1032655 - protein, 129 aa, Homo sapiens; identical to SEQ ID NO: 1032648

SEQ ID NO: 1032656 - protein, 129 aa, Homo sapiens; identical to SEQ ID NO: 1032648

SEQ ID NO: 1032657 - protein, 129 aa, Homo sapiens; identical to SEQ ID NO: 1032648

SEQ ID NO: 1032658 - protein, 43 aa, Homo sapiens
EKPESLEKILDSNRMGHQPPPPTQQHSIIDNSLSLKTPPECVL

SEQ ID NO: 1032659 - protein, 106 aa, Homo sapiens
HRWHSERTSAGNLQQTGQPLDLAVNGKGFFHILQLNNIAITDNSLSLKTPAERLRGPLPPSADDNLKTPSERQLTPLPPSAPPSADDNIKTKRLRGRFHRIRTGSL

SEQ ID NO: 1032660 - protein, 165 aa, Homo sapiens
DTRGERLRGASAGAGFHPQRMIISRHLPSVSSLPFHPQLLPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLSTPQRMIVSNTRGDEHTVPSSM

SEQ ID NO: 1032661 - protein, 96 aa, Homo sapiens
DVWLQHRHSASRLAPASVQTLSSCSSPQLYPQLHPQQMIISRHVPSVCSEAASTITDDNLKTPSERQLTPLPPSAPPSADKYQDTCQFPGGRTSSF

SEQ ID NO: 1032662 - protein, 256 aa, Homo sapiens; identical to SEQ ID NO: 1032643

SEQ ID NO: 1032663 - protein, 256 aa, Homo sapiens
MAAAEHRHSSGLPYWPYLTAETLKNRMGHQPPPPTQQHSITDNSLSLKTPPECLLIPLPPSADDNLKTPSERQLTPLPPSAPPSADDNIKIPAERLRIPLPPSADDNLKTPSERQLTPLPPSAPPSADDNIKTPAERLQLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTSPSTLSSTLSR

SEQ ID NO: 1032664 - protein, 300 aa, Homo sapiens
MAAAEHRHSSGLPYWPYLTAETLKNRMGHQPPPPTQQHSITDNSLSLKTPPECLLIPLPFHPQLHPQQMIISRHLPSVCGGRFHPQRMIISRHLPSVSSLPFHPQLHPQQMIISRYLLSVCGFRFHHQPMIISRHLPSVSSLPFHPQLHPQQMIISRHLPSVCSCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPLPPSAPPSADDNIKTPAERLRGAASTLSG

SEQ ID NO: 1032665 - protein, 129 aa, Homo sapiens; identical to SEQ ID NO: 1032648

SEQ ID NO: 1032666 - protein, 129 aa, Homo sapiens; identical to SEQ ID NO: 1032648

SEQ ID NO: 1032667 - protein, 129 aa, Homo sapiens; identical to SEQ ID NO: 1032648

SEQ ID NO: 1032668 - protein, 129 aa, Homo sapiens; identical to SEQ ID NO: 1032648

SEQ ID NO: 1032669 - protein, 129 aa, Homo sapiens; identical to SEQ ID NO: 1032648

SEQ ID NO: 1032670 - protein, 129 aa, Homo sapiens; identical to SEQ ID NO: 1032648

SEQ ID NO: 1032671 - protein, 129 aa, Homo sapiens; identical to SEQ ID NO: 1032648

SEQ ID NO: 1032672 - protein, 129 aa, Homo sapiens; identical to SEQ ID NO: 1032648

SEQ ID NO: 1032673 - protein, 734 aa, Homo sapiens
PFVNNNPGNLLHMGPKGRYGPAGAQRTVKDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 1032674 - protein, 576 aa, Homo sapiens
PFVNNNPGNLLHMGPKGRYGPAGAQRTVKDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAEDELVWSRQPPPSSPCLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 1032675 - protein, 734 aa, Homo sapiens; identical to SEQ ID NO: 1032673

SEQ ID NO: 1032676 - protein, 734 aa, Homo sapiens; identical to SEQ ID NO: 1032673

SEQ ID NO: 1032677 - protein, 95 aa, Homo sapiens
HLFMDGNVAFCSRLWLCPEQQRLPRRLVRVVSEITLPHNFHASFVCRGKGDYHRLGHGSDDHVRRPRQVQGLQGKKVIAIATGSLHCVCCTEDGR

SEQ ID NO: 1032678 - protein, 734 aa, Homo sapiens; identical to SEQ ID NO: 1032673

SEQ ID NO: 1032679 - protein, 734 aa, Homo sapiens; identical to SEQ ID NO: 1032673

SEQ ID NO: 1032680 - protein, 143 aa, Homo sapiens; identical to SEQ ID NO: 872032

SEQ ID NO: 1032681 - protein, 330 aa, Homo sapiens
MELLSTPHSIEINNITCDSFRISWAMEDSDLERVTHYFIDLNKKENKNSNKFKHRDVPTKLVAKAVPLPMTVRGHWFLSPRTEYSVAVQTAVKQSDGEYLVSGWSETVEFCTGDYAKEHLAQLQEKAEQIAGRMLRFSVFYRNHHKEYFQHARTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSLGTLGEISGHQLMSLSTADAKKDPSCKTCNISVGR

SEQ ID NO: 1032682 - protein, 199 aa, Homo sapiens
GLSPAHQPHLLFPLVCLPGVGRTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSLGTLGEISGHQLMSLSTADAKKDPSCKTCNISVGR

SEQ ID NO: 1032683 - protein, 330 aa, Homo sapiens; identical to SEQ ID NO: 1032681

SEQ ID NO: 1032684 - protein, 158 aa, Homo sapiens
MLEEVQKMQGCGIPGSSPSPGTFVTCFHSFLEQVSSSGNQQAIGAIRTLRSKRTPLPRKRQLMHSLFGDYRAQMEAEWREALRALRAAAYSAQVQPVDGATRKKSRVLPARPAEPGFQAQFPAPGILPLSVSAQSNLRAVTLTPERTPWAMKAAQRRK

SEQ ID NO: 1032685 - protein, 229 aa, Homo sapiens
MAALGHLAGEAAAAPGPGTPCASRGARLPGPVSSARNPSTVCLCPEQPTCSNADSRAHPLGDEGGTASKKQKNKKKTRNRASVANGGEKASEKLAPEEVPLSAEAQAQQLAQELAWCVEQLELGLKRQKPTPKQKEQAIGAIRTLRSKRTPLPRKRQLMHSLFGDYRAQMEAEWREALRALRAAAYSAQVQPVDGATRKKSQRVCRPRSIWRAKATLDMPDEEFRFNFF

SEQ ID NO: 1032686 - protein, 229 aa, Homo sapiens; identical to SEQ ID NO: 1032685

SEQ ID NO: 1032687 - protein, 126 aa, Homo sapiens
MPRAQQLAQELAWCVEQLELGLKRQKPTPKQKEQAIGAIRTLRSKRTPLPRKRQLMHSLFGDYRAQMEAEWREALRALRAAAYSAQVQPVDGATRKKSQRVCRPRSIWRAKATLDMPDEEFRFNFF

SEQ ID NO: 1032688 - protein, 229 aa, Homo sapiens; identical to SEQ ID NO: 1032685

SEQ ID NO: 1032689 - protein, 208 aa, Homo sapiens
MGSRGSRFHRTGGPSLFGGPGGEREEAAYAIVSAFRRLLVLLLILLLLSGGRGRVYRVEQEGEMGAWPLKHSIAGSRLGLRITAGQLGWCRAFHKRWRSRVFSGLPRGRGDSLSWSAGWRVFFLDTGAAAGPWSTWRRASSRMLALPLDQGALLLALSGHDRGLALLSCGHFSLCLLGSYLCVAWFFLGCGCGARIIVVLGWRVVAAD

SEQ ID NO: 1032690 - protein, 208 aa, Homo sapiens; identical to SEQ ID NO: 1032689

SEQ ID NO: 1032691 - protein, 110 aa, Homo sapiens
MGTCDLGSAELRRGGAWDGAGGYGFPVPSHSHFPKSITGTTVGPGIGLVCGATGAGPQEAETHPETERDPSVELGDVNSGTAWPCRCWAEYGVGGALRRGGTEVRNRGCP

SEQ ID NO: 1032692 - protein, 208 aa, Homo sapiens; identical to SEQ ID NO: 1032689

SEQ ID NO: 1032693 - protein, 208 aa, Homo sapiens; identical to SEQ ID NO: 1032689

SEQ ID NO: 1032694 - protein, 229 aa, Homo sapiens; identical to SEQ ID NO: 1032685

SEQ ID NO: 1032695 - protein, 126 aa, Homo sapiens; identical to SEQ ID NO: 1032687

SEQ ID NO: 1032696 - protein, 229 aa, Homo sapiens; identical to SEQ ID NO: 1032685

SEQ ID NO: 1032697 - protein, 134 aa, Homo sapiens
KKRRKKAGEAGGGRGENDPRTDQSPRAAASRVQHLRPAAVAAATMPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 1032698 - protein, 90 aa, Homo sapiens
MPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 1032699 - protein, 90 aa, Homo sapiens; identical to SEQ ID NO: 1032698

SEQ ID NO: 1032700 - protein, 90 aa, Homo sapiens; identical to SEQ ID NO: 1032698

SEQ ID NO: 1032701 - protein, 123 aa, Homo sapiens
RYKNFYKTPRSPSSVKKRRERPPDRPKPVAAATMPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 1032702 - protein, 166 aa, Homo sapiens
MTAARPAQNTPRQQTRQPQESTTQNQAARPPTRHATTRAERKTHDQPHNDTTPPTHSARRQNTTNRQYTHTQTVASTAQQPPPRRRHTHTLSAASRHTKRPPRRNTRDRTQHRSAPRRHTEQATQAKTAKRTNTATRDKQQTQTTTTDNNQHREQHTRRAYEPVYS

SEQ ID NO: 1032703 - protein, 123 aa, Homo sapiens; identical to SEQ ID NO: 1032701

SEQ ID NO: 1032704 - protein, 132 aa, Homo sapiens
PWVFPRNPPEPWDIEWAGPNILEEHPTKTFGGGGENFLLPLVPFGWLWVVFLPVPLYLMFHLFPSSFPAQKKKPAPPKPEPKPKKAPAKKGEKVPKGKKGKADAGKEGNNPAENGDAKTDQAQKAEGAGDAK

SEQ ID NO: 1032705 - protein, 134 aa, Homo sapiens; identical to SEQ ID NO: 1032697

SEQ ID NO: 1032706 - protein, 102 aa, Homo sapiens
MPKRKAEGDAKGDKAKVKDEPQRRSARLSAKPAPPKPEPKPKKAPAKKGEKVPKGKKGKADAGPGGGIPVTLTHYGHLGTKALWYRKTNLFLCPLLPFHLSA

SEQ ID NO: 1032707 - protein, 90 aa, Homo sapiens; identical to SEQ ID NO: 1032698

SEQ ID NO: 1032708 - protein, 90 aa, Homo sapiens; identical to SEQ ID NO: 1032698

SEQ ID NO: 1032709 - protein, 90 aa, Homo sapiens; identical to SEQ ID NO: 1032698

SEQ ID NO: 1032710 - protein, 883 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVVVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032711 - protein, 174 aa, Homo sapiens
RRRIPFRRGAASCMVVPLDRRLSDADWERALLMRRANVTGGHWPHAMCHLRLVSHLSSGLSTQAARLTPERRESGAGLGAKAGALRSVPRMVALFVLNTPSTGSGFLTCCGGREGGWPHVLEGFHPGPQLPAVRVPGAAAGAHGPIRVSTAPLQCVHPTMSAALLPACRALITA

SEQ ID NO: 1032712 - protein, 939 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032713 - protein, 939 aa, Homo sapiens; identical to SEQ ID NO: 1032712

SEQ ID NO: 1032714 - protein, 943 aa, Homo sapiens
MSAHCNLFCRVQAILLPQPPELAGNYRKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032715 - protein, 988 aa, Homo sapiens
MPAVSKGDGMRGLAVFISDIRNCKSNPTSLIIHTERNVSGWNEQDTEVVGYVKKEKNNGEDSYICQQLKDNVQVTEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032716 - protein, 939 aa, Homo sapiens; identical to SEQ ID NO: 1032712

SEQ ID NO: 1032717 - protein, 588 aa, Homo sapiens
MCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032718 - protein, 948 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQVRPSGNGGTHWSCSLFWHNVRGEMRSSLVQFSQF

SEQ ID NO: 1032719 - protein, 685 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLVVGGGAETMIREQRRKVEDSKTE

SEQ ID NO: 1032720 - protein, 202 aa, Homo sapiens [sequence omitted]

SEQ ID NO: 1032721 - protein, 576 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPPHTSPLWAGREHTCVAQEEKLSLDCGSHGRRWILGSIFIKIETVLWLNLQIKGKLEVGVNVAFVGVSLRWPVLPPTPPRSLWEQQCHCAWRGLSLGVWPSWWLHTWRRPGPLGGAQLTLVLLQSQLDCFPRQDFNLEFRNICICNDFWQKHVSWPDVTVLLSQLLFVKGVCYAPAVAEALDVQPGEERPAGPAGPPGLQGKVWAGGARLRGVLVSFLSEWASPGHGAGLSPSTGPVQSSLEGLWRKDASVWSGSEGAIGRMPCATCGLCLTCHLDSAPRLHV

SEQ ID NO: 1032722 - protein, 202 aa, Homo sapiens [sequence omitted]

SEQ ID NO: 1032723 - protein, 353 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLQAQMYRLTLRTSKEAVSQRLCELLSAQF

SEQ ID NO: 1032724 - protein, 927 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAGAVKAWTGCCGVAGCVSDSALWSASVWLRDICSGCKRGVLENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032725 - protein, 936 aa, Homo sapiens
MTRYESCCYGPGAVRPDQSGKCPEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032726 - protein, 939 aa, Homo sapiens; identical to SEQ ID NO: 1032712

SEQ ID NO: 1032727 - protein, 807 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFR

SEQ ID NO: 1032728 - protein, 527 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHK

SEQ ID NO: 1032729 - protein, 327 aa, Homo sapiens
MPPFPERESSILAKLKKKKGPSTVTDLEDTKRDRSVDVNGGPEPAPASTSAVSTPSPSADLLGLGAGAVKAWTGCCGVAGCVSDSALWSASVWLRDICSGCKRGVLENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032730 - protein, 143 aa, Homo sapiens
MSLSAAAAAGRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 1032731 - protein, 939 aa, Homo sapiens; identical to SEQ ID NO: 1032712

SEQ ID NO: 1032732 - protein, 698 aa, Homo sapiens
ILGAASCILWGTARDAPLCGRGPQERSWESIDAELGPTPWLLQRAGSGFAQIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 1032733 - protein, 670 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDVREGPDLDRPGSDRQERERARGDSEALDEES

SEQ ID NO: 1032734 - protein, 656 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 1032735 - protein, 639 aa, Homo sapiens [sequence omitted]

SEQ ID NO: 1032736 - protein, 639 aa, Homo sapiens [sequence omitted]

SEQ ID NO: 1032737 - protein, 508 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRGAQAAPLLPRLAGEQSRELWGTLCCLYLFPWVFFSCLISVISNQHEMTINGFLMKKETHQKTSGLRGPVVIVGTIPARVIVGTIRARVTRRVWRRAGPHQTGIPGPNGGRGGPWPEFFGSQAGWIGSPGPVLFLRAGVWSRPVPRAGPLLTAGV

SEQ ID NO: 1032738 - protein, 80 aa, Homo sapiens
QNNPHASSAPPPVSSSDSEAPEANPADGSDADEDDEDRGVMAVTAVTATAASDRMESDSDSDKSSDNSGLKGSTTSRMAP

SEQ ID NO: 1032739 - protein, 642 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRREGADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 1032740 - protein, 612 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEVPECPRGAGNPAGDLSDPPEEHRRGGHLEEDSPLQSEQGRNGEGSRSLYPAQVAGPRPKDRGGAESEQGWDGEGEGRGEAGRGGAGRGGGPPGEGGGQAQHRSLSPSEWRGHITEGGERRGQGARGGSGLGGGAKVWLL

SEQ ID NO: 1032741 - protein, 444 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRSGPTAGRLSGAAAAAAGTSSGRTMSPSRSGDARAGAGVPRPPLTPSPRPSWRERPRNQRRSRSPQAQSPPGNLARRRRECGPRRSNKPSP

SEQ ID NO: 1032742 - protein, 670 aa, Homo sapiens; identical to SEQ ID NO: 1032733

SEQ ID NO: 1032743 - protein, 574 aa, Homo sapiens
MLSAPCCDDRRMCVCPGPRRIGIPVRSSSLPLFSDAMPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKMSVLSLDLTAIKLPANAPIEDRRSAATCLQTRGMLLGVFDGHAGCAWSQAVSERLFYYIAGSLVPHETLLEIENAVESGRALLPILQWHKHPNDYFSKEASKLYFNSLRTYWQELIDLNTGESTDIDVKEALINAFKRLDNDISLEAQVGDPNSFLNYLVLRVAFSGATACVAHVDGVDLHVANTGDSRAMLGVQEEDGSWSAVTLSNDHNAQNERELERLKLEHPKSEAKSVVKQDRLLGLLMPFRAFGDVKFKWSIDLQKRVIESGPDQLNDNEYTKFIPPNYHTPPYLTAEPEVTYHRLRPQDKFLVLATDGLWETMHRQDVVRIVGEYLTGMHHQQPIAVGGYKVTLGQMHGLLTERRTKMSSVFEDQNAATHLIRHAVGNNEFGTVDHERLSKMLSLPEELARMYRDDITIIVVQFNSHVVGAYQNQEK

SEQ ID NO: 1032744 - protein, 194 aa, Homo sapiens
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCAWSQAVSERLFYYIAGSLVPHETLLEIDDSFVGGSQWALNLGLPG

SEQ ID NO: 1032745 - protein, 537 aa, Homo sapiens
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCAWSQAVSERLFYYIAGSLVPHETLLEIENAVESGRALLPILQWHKHPNDYFSKEASKLYFNSLRTYWQELIDLNTGESTDIDVKEALINAFKRLDNDISLEAQVGDPNSFLNYLVLRVAFSGATACVAHVDGVDLHVANTGDSRAMLGVQEEDGSWSAVTLSNDHNAQNERELERLKLEHPKSEAKSVVKQDRLLGLLMPFRAFGDVKFKWSIDLQKRVIESGPDQLNDNEYTKFIPPNYHTPPYLTAEPEVTYHRLRPQDKFLVLATDGLWETMHRQDVVRIVGEYLTGMHHQQPIAVGGYKVTLGQMHGLLTERRTKMSSVFEDQNAATHLIRHAVGNNEFGTVDHERLSKMLSLPEELARMYRDDITIIVVQFNSHVVGAYQNQE

SEQ ID NO: 1032746 - protein, 537 aa, Homo sapiens; identical to SEQ ID NO: 1032745

SEQ ID NO: 1032747 - protein, 390 aa, Homo sapiens
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCAWSQAVSERLFYYIAGSLVPHETLLEIENAVESGRALLPILQWHKHPNDYFSKEASKLYFNSLRTYWQELIDLNTGESTDIDVKEALINAFKRLDNDISLEAQVGDPNSFLNYLVLRVAFSGATACVAHVDGVDLHVANTGDSRAMLGVQEEDGSWSAVTLSNDHNAQNERELERLKLEHPKSEAKSVVKQDRLLGLLMPFRAFGDVKFKWSIDLQKRVIESGPLPGRQGPQHWCGPFSSS

SEQ ID NO: 1032748 - protein, 129 aa, Homo sapiens
MSHEKSFLVSGDNYPPPNPGYPGGPQPPMPPYAQPPYPGAPLTQQTPFFADSRRTIRVQGNTGVNTPNVAPKTPGKATRGGNRTKMKDTSEQNRLRDKSHRGERHKQQVREQKDTRENRKNEKAEMKKQ

SEQ ID NO: 1032749 - protein, 83 aa, Homo sapiens
HGAAVGSHALLRAQAPGLPTARGKGRTAEPEAMSHEKSFLVSGDNYPPPNPGYPGGPQPPMPPYAQPPYPGAPYPQPLGRPAR

SEQ ID NO: 1032750 - protein, 174 aa, Homo sapiens
MVISMGPTSPSCSGESMAISTRPSCPGNPLEVSTGPADPTGPRLMGPSCSCNPTGLRLTSPSCSRDPMGIELTCSACPRDPMGPVLREVPDCPGSWPEPVVIIPLPCTMGPVLREAPDCPGSSPEPIVTVPAPCRAVTNPPVLRRACLVALGPWVDGWSPPLVFSASSSGSRMS

SEQ ID NO: 1032751 - protein, 174 aa, Homo sapiens; identical to SEQ ID NO: 1032750

SEQ ID NO: 1032752 - protein, 174 aa, Homo sapiens; identical to SEQ ID NO: 1032750

SEQ ID NO: 1032753 - protein, 174 aa, Homo sapiens; identical to SEQ ID NO: 1032750

SEQ ID NO: 1032754 - protein, 174 aa, Homo sapiens; identical to SEQ ID NO: 1032750

SEQ ID NO: 1032755 - protein, 174 aa, Homo sapiens; identical to SEQ ID NO: 1032750

SEQ ID NO: 1032756 - protein, 174 aa, Homo sapiens; identical to SEQ ID NO: 1032750

SEQ ID NO: 1032757 - protein, 371 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032758 - protein, 371 aa, Homo sapiens; identical to SEQ ID NO: 1032757

SEQ ID NO: 1032759 - protein, 131 aa, Homo sapiens
MVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032760 - protein, 271 aa, Homo sapiens
RYPPDQPDSPPRLARQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032761 - protein, 174 aa, Homo sapiens; identical to SEQ ID NO: 1032750

SEQ ID NO: 1032762 - protein, 174 aa, Homo sapiens; identical to SEQ ID NO: 1032750

SEQ ID NO: 1032763 - protein, 161 aa, Homo sapiens
GTRKLAIIPTMYDRLAVRTDSCNLVPGVLSPEVPTTAEDNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032764 - protein, 125 aa, Homo sapiens
MAIGVGGRVAVLHRQGGAPGEIHALPVDRGVAAAEAAVEAVGADVRHCRCRRAVVQHLLHRAPLASLQQALPVQLILLLQQRVRHALHLRGRPGPGLNTLPTPWGRRRAELSLATRSPLLEESRV

SEQ ID NO: 1032765 - protein, 133 aa, Homo sapiens
MAIGVGGRVAVLHRQGGAPGEIHALPVDRGVAAAEAAVEAVGADVRHCRCRRAVVQHLLHRAPLASLQQALPVQLILLLQQRVRHALHTNDADAAAGSVQGVVEGPHHLLELPGVLCQTLQVVPGPLQRLPRH

SEQ ID NO: 1032766 - protein, 174 aa, Homo sapiens; identical to SEQ ID NO: 1032750

SEQ ID NO: 1032767 - protein, 174 aa, Homo sapiens; identical to SEQ ID NO: 1032750

SEQ ID NO: 1032768 - protein, 174 aa, Homo sapiens; identical to SEQ ID NO: 1032750

SEQ ID NO: 1032769 - protein, 174 aa, Homo sapiens; identical to SEQ ID NO: 1032750

SEQ ID NO: 1032770 - protein, 223 aa, Homo sapiens
MAIGVGGRVAVLHRQGGAPGEIHALPVDRGVAAAEAAVEAVGADVRHCRCRRAVVQHLLHRAPLASLQQALPVQLILLLQQRVRHALHTNDADAAAGSVQGVVEGPHHLLELPGVLCQTLQVVPGPLQRLPRQPWHRSRRARSSAGSVRRQGPTVSSWTWTSKAALSARSSSSTSCSKAECTTSWALPSVPPSGGSSASNGGCSSRERVRACRRAAASSCSAT

SEQ ID NO: 1032771 - protein, 388 aa, Homo sapiens
MRIRAWPPRGRTAEPEAMSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032772 - protein, 425 aa, Homo sapiens
PAAVFRAAGAGPAERPPSGCGCGRIGHHRAAAQRTPCVPACGARPPGRTAEPEAMSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032773 - protein, 371 aa, Homo sapiens; identical to SEQ ID NO: 1032757

SEQ ID NO: 1032774 - protein, 455 aa, Homo sapiens
PAAVFRAAGAGPAERPPSGCGCGRIGHHRAAAQRTPCVPACGARPPGRTAEPEAMSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDCESQEGRGGVAGRAGGGACELALTQPVCFSAPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032775 - protein, 266 aa, Homo sapiens
LRLVEAGFNRPRKVLPSYRPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032776 - protein, 202 aa, Homo sapiens
GTRKLAIIPTMYDRLAVRTDSCNLVPGVLSPEVPTTAEDDERDEEDSIGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1032777 - protein, 136 aa, Homo sapiens
MAIGVGGRVAVLHRQGGAPGEIHALPVDRGVAAAEAAVEAVGADVRHCRCRRAVVQHLLHRAPLASLQQALPVQLILLLQQRVRHALHTNDADAAAGSVQGVVEGPHHLLELPGVLCQTLQVVPGPLQRLPRQGRA

SEQ ID NO: 1032778 - protein, 512 aa, Homo sapiens
MHTPDFAGPDDARAVDIMDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 1032779 - protein, 136 aa, Homo sapiens
MDICESILERKRHDSERSTCSILEQTDMEAVEALVCMSSWGQRSQKGDLLRIRPLTPVSDSGDVTTTVHMDAATPELPKDFHSLSTLVRGGGREERFVHMTRVAELSVLKNLCRRFPGMLANKLRILSVWVLTEYE

SEQ ID NO: 1032780 - protein, 495 aa, Homo sapiens
MDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 1032781 - protein, 414 aa, Homo sapiens
MVLFFKCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 1032782 - protein, 440 aa, Homo sapiens
MHTPDFAGPDDARAVDIMDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKVCVPGV

SEQ ID NO: 1032783 - protein, 512 aa, Homo sapiens; identical to SEQ ID NO: 1032778

SEQ ID NO: 1032784 - protein, 512 aa, Homo sapiens; identical to SEQ ID NO: 1032778

SEQ ID NO: 1032785 - protein, 115 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAAR

SEQ ID NO: 1032786 - protein, 367 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCKYGFVFLWASVVELVPHAVMLGTSSRE

SEQ ID NO: 1032787 - protein, 942 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032788 - protein, 989 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLGKSNLAELPPMAKRYTHMCNLVEKNERVSPCLRSVVYLCVCGGSSLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032789 - protein, 811 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032790 - protein, 752 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKWKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032791 - protein, 942 aa, Homo sapiens; identical to SEQ ID NO: 1032787

SEQ ID NO: 1032792 - protein, 685 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032793 - protein, 924 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALWGHPEYTCLYRFRVHGEPVK

SEQ ID NO: 1032794 - protein, 942 aa, Homo sapiens; identical to SEQ ID NO: 1032787

SEQ ID NO: 1032795 - protein, 920 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLAGEALQMLQAPEGPPHTFLGGLRFFYLGHLRYRLVGAYGDLQGDT

SEQ ID NO: 1032796 - protein, 873 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKSGSAVFVKCSIFSSKLEV

SEQ ID NO: 1032797 - protein, 583 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPRGRERVTGALAPPVGCSLPLQVQRGQQQEKRVEHVALRHSLFLTGSSLHLHFLNKGAKQRKLRVWRVLDALVFSLALALLKDFWRADNFIC

SEQ ID NO: 1032798 - protein, 745 aa, Homo sapiens
RVSRAWAAQTRPEAAARGSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKWKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032799 - protein, 139 aa, Homo sapiens
PGTVLSQILMCWDYEAEQLHPTQNYFKQANLCIVWATHTIQPEGGGPFTSLLVARALSAAFTCVVGAIGCGNSVEVASLAHPLIMLTSSGCEKHLSLASVSSLSLFCVCCSSCQLLWENECERGSQRGWPPQCKWGSAV

SEQ ID NO: 1032800 - protein, 1049 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCKYGFVFLWASVVELVPHAVMLGTSSERMNGPCDMVVLTDDDGLLELLLKPSPQKLIATRSHLLCLLTVSCVIEFPSFYRLPLLCTAEMDRVCCVNPPHSLPVTTPAGDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032801 - protein, 909 aa, Homo sapiens
RVSRAWAAQTRPEAAARGSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032802 - protein, 806 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKSHASYYGRMNVREVLREDGHLSVNGEALWKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032803 - protein, 709 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032804 - protein, 680 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPREAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 1032805 - protein, 942 aa, Homo sapiens; identical to SEQ ID NO: 1032787

SEQ ID NO: 1032806 - protein, 895 aa, Homo sapiens
SGSLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLALGRPSSSHTFLGVPTDESK

SEQ ID NO: 1032807 - protein, 257 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAPPGPVSRVYSRDRNQKCKSQSFKTQKKVCFPNLIFPFCKSQCLHYLSWRLKIIP

SEQ ID NO: 1032808 - protein, 158 aa, Homo sapiens
FVEVAGGLCLLWNSCRKIGGDVDVIDQNRALVDGPCTQVRRQAMPFKCMQLTDFILKFPHSAHQKYVRQAWQKADINTKWAATRWAKKIEARERKAKMTDFDRFKVMKAKKMRNRIIKNEVKKLQKAALLKASPKKAPGTKGSCCCCCCCCCCCCCCC

SEQ ID NO: 1032809 - protein, 143 aa, Homo sapiens
ALRSPGVHSIDQNRALVDGPCTQVRRQAMPFKCMQLTDFILKFPHSAHQKYVRQAWQKADINTKWAATRWAKKIEARERKAKMTDFDRFKVMKAKKMRNRIIKNEVKKLQKAALLKASPKKAPGTKGSCCCCCCCCCCCCCCC

SEQ ID NO: 1032810 - protein, 135 aa, Homo sapiens
VYYILRSSWSWTLHSVRRQAMPFKCMQLTDFILKFPHSAHQKYVRQAWQKADINTKWAATRWAKKIEARERKAKMTDFDRFKVMKAKKMRNRIIKNEVKKLQKAALLKASPKKAPGTKGSCCCCCCCCCCCCCCC

SEQ ID NO: 1032811 - protein, 158 aa, Homo sapiens; identical to SEQ ID NO: 1032808

SEQ ID NO: 1032812 - protein, 73 aa, Homo sapiens
ALRSPGVHSIDQNRALVDGPCTQVRRQAMPFKCMQLTDFILKFPHSAHQKYVRQAWQKADINTHVQPGDNLGH

SEQ ID NO: 1032813 - protein, 158 aa, Homo sapiens; identical to SEQ ID NO: 1032808

SEQ ID NO: 1032814 - protein, 289 aa, Homo sapiens
MHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 1032815 - protein, 158 aa, Homo sapiens
SREFSSLLSRGCLSTSRIDMDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNISPRYVLWLCGALAPQVALRILSQA

SEQ ID NO: 1032816 - protein, 1121 aa, Homo sapiens
MDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVGDLRVPGGRVQNIGHCFGHSARVWQVKLLENYLISAGEDCVCLVWSHEGEILQAFRGHQGRGIRAIAAHERQAWVITGGDDSGIRLWHLVGRGYRGLGVSALCFKSRSRPGTLKAVTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGDFLVCGDRRGSVLLFPSRPGLLKDPGVGGKARAGAGAPVVGSGSSGGGNAFTGLGPVSTLPSLHGKQGVTSVTCHGGYVYTTGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 1032817 - protein, 1121 aa, Homo sapiens; identical to SEQ ID NO: 1032816

SEQ ID NO: 1032818 - protein, 1140 aa, Homo sapiens
SREFSSLLSRGCLSTSRIDMDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVGDLRVPGGRVQNIGHCFGHSARVWQVKLLENYLISAGEDCVCLVWSHEGEILQAFRGHQGRGIRAIAAHERQAWVITGGDDSGIRLWHLVGRGYRGLGVSALCFKSRSRPGTLKAVTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGDFLVCGDRRGSVLLFPSRPGLLKDPGVGGKARAGAGAPVVGSGSSGGGNAFTGLGPVSTLPSLHGKQGVTSVTCHGGYVYTTGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 1032819 - protein, 1140 aa, Homo sapiens; identical to SEQ ID NO: 1032818

SEQ ID NO: 1032820 - protein, 1140 aa, Homo sapiens; identical to SEQ ID NO: 1032818

SEQ ID NO: 1032821 - protein, 1121 aa, Homo sapiens; identical to SEQ ID NO: 1032816

SEQ ID NO: 1032822 - protein, 1121 aa, Homo sapiens; identical to SEQ ID NO: 1032816

SEQ ID NO: 1032823 - protein, 1140 aa, Homo sapiens; identical to SEQ ID NO: 1032818

SEQ ID NO: 1032824 - protein, 1140 aa, Homo sapiens; identical to SEQ ID NO: 1032818

SEQ ID NO: 1032825 - protein, 1121 aa, Homo sapiens; identical to SEQ ID NO: 1032816

SEQ ID NO: 1032826 - protein, 1121 aa, Homo sapiens; identical to SEQ ID NO: 1032816

SEQ ID NO: 1032827 - protein, 1121 aa, Homo sapiens; identical to SEQ ID NO: 1032816

SEQ ID NO: 1032828 - protein, 1121 aa, Homo sapiens; identical to SEQ ID NO: 1032816

SEQ ID NO: 1032829 - protein, 1140 aa, Homo sapiens; identical to SEQ ID NO: 1032818

SEQ ID NO: 1032830 - protein, 1140 aa, Homo sapiens; identical to SEQ ID NO: 1032818

SEQ ID NO: 1032831 - protein, 250 aa, Homo sapiens
SREFSSLLSRGCLSTSRIDMDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATAFIPLCTSHPVLLCAHPQDVYPVVVGAEIHAELYQELAYQ

SEQ ID NO: 1032832 - protein, 1140 aa, Homo sapiens; identical to SEQ ID NO: 1032818

SEQ ID NO: 1032833 - protein, 1140 aa, Homo sapiens; identical to SEQ ID NO: 1032818

SEQ ID NO: 1032834 - protein, 1140 aa, Homo sapiens; identical to SEQ ID NO: 1032818

SEQ ID NO: 1032835 - protein, 1140 aa, Homo sapiens; identical to SEQ ID NO: 1032818

SEQ ID NO: 1032836 - protein, 1140 aa, Homo sapiens; identical to SEQ ID NO: 1032818

SEQ ID NO: 1032837 - protein, 1121 aa, Homo sapiens; identical to SEQ ID NO: 1032816

SEQ ID NO: 1032838 - protein, 1121 aa, Homo sapiens; identical to SEQ ID NO: 1032816

SEQ ID NO: 1032839 - protein, 1121 aa, Homo sapiens; identical to SEQ ID NO: 1032816

SEQ ID NO: 1032840 - protein, 1121 aa, Homo sapiens; identical to SEQ ID NO: 1032816

SEQ ID NO: 1032841 - protein, 1121 aa, Homo sapiens; identical to SEQ ID NO: 1032816

SEQ ID NO: 1032842 - protein, 1121 aa, Homo sapiens; identical to SEQ ID NO: 1032816

SEQ ID NO: 1032843 - protein, 1121 aa, Homo sapiens; identical to SEQ ID NO: 1032816

SEQ ID NO: 1032844 - protein, 1121 aa, Homo sapiens; identical to SEQ ID NO: 1032816

SEQ ID NO: 1032845 - protein, 379 aa, Homo sapiens
MEVKPPPGCPQPDSGSRRRRWGEEGHDPKEPEQLRKLFIGGLSFETTDDSLREHFEKWGTLTDCLVMRDPQTKRSRGFGFVTYSCVTEVDAAIGARPFKVDGRVVEPKRAVSREDSVKPGAHLTVKKIFVGSIKEDTEEYNLRDYFEKYGKIETIEVMEDRQSGKKRGFASVTFDDHDTVDKIVVQKYHTINGHNCEVKKALAKQVMQPAGSQRGRGGGSGNCMGHRGNFGGGGGNFGRDGNFGGRGGYGGGGGGSRGSYGGGDVDDNGLGGDGGNYGSGPGYSSRGGYGGGGPGYGNQGGGYGGGVGGYDGYNEGGNFGGGNYGGGGNYNDFGNYSGQQQSNYGPMKGGSFGGRSSGSPYGGGYGSGGGSGGYGSRRF

SEQ ID NO: 1032846 - protein, 379 aa, Homo sapiens; identical to SEQ ID NO: 1032845

SEQ ID NO: 1032847 - protein, 269 aa, Homo sapiens
MEVKPPPGCPQPDSGSRRRRWGEEGHDPKEPEQLRKLFIGGLSFETTDDSLREHFEKWGTLTDCLVMRDPQTKRSRGFGFVTYSCVTEVDAAIGARPFKVDGRVVEPKRAVSREDSVKPGAHLTVKKIFVGSIKEDTEEYNLRDYFEKYGKIETIEVMEDRQSGKKRGFASVTFDDHDTVDKIVVQKYHTINGHNCEVKKALAKQVMQPAGSQRGRGGGSGNCMGHRGNFGGGGGNFGRDGNFGGRGGYGGGGGGSRGSYGGGDVDIMD

SEQ ID NO: 1032848 - protein, 165 aa, Homo sapiens
MGFSRVLCFTNSRENSHRLFLLVQAFGGVDVAEFSSRYGPGQRRMILKQFEQGKIQLLISTDATARGIDVQGVELVVNYDAPQYLRTYVHRVGRTARAGKTGQAFTLLLKVQERRFLRMLTEAGAPELQRHELSSKLLQPLVPRYEEALSQLEESVKEERKQRAA

SEQ ID NO: 1032849 - protein, 165 aa, Homo sapiens; identical to SEQ ID NO: 1032848

SEQ ID NO: 1032850 - protein, 165 aa, Homo sapiens; identical to SEQ ID NO: 1032848

SEQ ID NO: 1032851 - protein, 377 aa, Homo sapiens
MHQSWLPRVVAAAFQSEDPADPCALLQRRQAQAVTAASTCCPQMPLQKLLFSATLTQNPEKLQQLGLHQPRLFSTGLAHRGLEDTDGDGDSGKYAFPVGLTHHYVPCSLSSKPLVVLHLVLEMGFSRVLCFTNSRENSHRLFLLVQAFGGVDVAEFSSRYGPGQRRMILKQFEQGKIQLLISTDATARGIDVQGVELVVNYDAPQYLRTYVHRVGRTARAASTGGSGALELLGVDVETVLTGMGWAWCGEKLSFRQTLEGSGASLEIAAFDSRVGRTARAGKTGQAFTLLLKVQVRLRGSWEFLLLVGVKGLAQEPPSTMSFLQERRFLRMLTEAGAPELQRHELSSKLLQPLVPRYEEALSQLEESVKEERKQRAA

SEQ ID NO: 1032852 - protein, 261 aa, Homo sapiens
MHQSWLPRVVAAAFQSEDPADPCALLQRRQAQAVTAASTCCPQMPLQKLLFSATLTQNPEKLQQLGLHQPRLFSTGLAHRGLEDTDGDGDSGKYAFPVGLTHHYVPCSLSSKPLVVLHLVLEMGFSRVLCFTNSRENSHRLFLLVQAFGGVDVAEFSSRYGPGQRRMILKQFEQGKIQLLISTDATARGIDVQGVELVVNYDAPQYLRTYVHRVGRTARAEQAAAAAGSSVRGGPVPAGGVCQGRAQAEGGLGWGSEGRRD

SEQ ID NO: 1032853 - protein, 165 aa, Homo sapiens; identical to SEQ ID NO: 1032848

SEQ ID NO: 1032854 - protein, 165 aa, Homo sapiens; identical to SEQ ID NO: 1032848

SEQ ID NO: 1032855 - protein, 165 aa, Homo sapiens; identical to SEQ ID NO: 1032848

SEQ ID NO: 1032856 - protein, 214 aa, Homo sapiens
TVWAEGCTGNLGPLTNPHLHPDPLPSLEHHYVPCSLSSKPLVVLHLVLEMGFSRVLCFTNSRENSHRLFLLVQAFGGVDVAEFSSRYGPGQRRMILKQFEQGKIQLLISTDATARGIDVQGVELVVNYDAPQYLRTYVHRVGRTARAGKTGQAFTLLLKVQERRFLRMLTEAGAPELQRHELSSKLLQPLVPRYEEALSQLEESVKEERKQRAA

SEQ ID NO: 1032857 - protein, 165 aa, Homo sapiens; identical to SEQ ID NO: 1032848

SEQ ID NO: 1032858 - protein, 165 aa, Homo sapiens; identical to SEQ ID NO: 1032848

SEQ ID NO: 1032859 - protein, 165 aa, Homo sapiens; identical to SEQ ID NO: 1032848

SEQ ID NO: 1032860 - protein, 165 aa, Homo sapiens; identical to SEQ ID NO: 1032848

SEQ ID NO: 1032861 - protein, 165 aa, Homo sapiens; identical to SEQ ID NO: 1032848

SEQ ID NO: 1032862 - protein, 59 aa, Homo sapiens [sequence omitted]

SEQ ID NO: 1032863 - protein, 312 aa, Homo sapiens
MDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 1032864 - protein, 312 aa, Homo sapiens
MDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVVPRGATAAVLAPDSSNASSEPSS

SEQ ID NO: 1032865 - protein, 353 aa, Homo sapiens
MDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIPFKLAKMAAVSKASGRFGLLQGTSAETSGGLLICLPREQAARFCSEIKSSKYGEGHQAWIVGIVEKGNRTARIIDKPRVIEVPFVGPPFPGCLVGPQLLFLLLTVQMPPLSLAREMKEQKLFGP

SEQ ID NO: 1032866 - protein, 312 aa, Homo sapiens
MDSCVIPLRHGGLSLVQTTDFFYPLVEDPYMMGRIACANVLSDLYAMGITECDNMLMLLSVSQSMSEEERGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 1032867 - protein, 290 aa, Homo sapiens
HLGTSYAPHHVGIFYQGVKVVLVCTSDRPPCLRGMTQESIPMPRAGKGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 1032868 - protein, 330 aa, Homo sapiens
MDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLKSNPPSTERVTKRGSLALWKRETERPGSLTSRELLKSCLVGPQLLFLLLTVQMPPLSLAREMKEQKLFGP

SEQ ID NO: 1032869 - protein, 330 aa, Homo sapiens
MDSCVIPLRHGGLSLVQTTDFFYPLVEDPYMMGRIACANVLSDLYAMGITECDNMLMLLSVSQSMSEEEREKVTPLMVKGFRDAAEEGGTAVTGGQTVVNPWIIIGGVATVVCQPNEFIMPDSAVVGDVLVLTKPLGTQVAVNAHQWLDNPERWNKVKMVVSREEVELAYQEAMFNMATLNRTAAGLMHTFNAHAATDITGFGILGHSQNLAKQQRNEVSFVIHNLPIIAKMAAVSKASGRFGLLQGTSAETSGGLLICLPREQAARFCSEIKSSKYGEGHQAWIVGIVEKGNRTARIIDKPRVIEVLPRGATAAVLAPDSSNASSEPSS

SEQ ID NO: 1032870 - protein, 330 aa, Homo sapiens; identical to SEQ ID NO: 1032869

SEQ ID NO: 1032871 - protein, 59 aa, Homo sapiens [sequence omitted]

SEQ ID NO: 1032872 - protein, 102 aa, Homo sapiens
HVISHISQNNLGKYYFHPFSVSNRTQQETRVREGLVQGGPLKSGPPAAAHAGASLVFWVHAMTVLIGHTGGPEPLTTSRQREMHAVASAQKVGTGWKVLLYK

SEQ ID NO: 1032873 - protein, 3078 aa, Homo sapiens
AGRRRGFHPPALLTRPERSPEAQGERHIGYRREVIMHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKGGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032874 - protein, 3090 aa, Homo sapiens
LAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032875 - protein, 3054 aa, Homo sapiens
LAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032876 - protein, 3124 aa, Homo sapiens
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQFRQFTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLPKPPVVSVPAAVVSSPGVTTLPMNVAGISVAIGQPQKAAGQTVVAQPVHMQQLLKLKQQAVQQQKAIQPQAAQGPATVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032877 - protein, 3078 aa, Homo sapiens
MSAYCNLCLPGSSILLPQPPEYLGLQGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032878 - protein, 2854 aa, Homo sapiens
MAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQQIHMVTPVPGDVNAIKMEASKGSEHWRPQENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032879 - protein, 274 aa, Homo sapiens
MSRRGRDPARRLAKPPVVSVPAAVVSSPGVTTLPMNVAGISVAIGQPQKAAGQERVCWTPKTAVRAIAGQDMALYLVRRDRAQFASSQTWHITAPEELSTWGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032880 - protein, 3078 aa, Homo sapiens; identical to SEQ ID NO: 1032873

SEQ ID NO: 1032881 - protein, 2195 aa, Homo sapiens
AGRRRGFHPPALLTRPERSPEAQGERHIGYRREVIMHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKGGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMVPGPGPSCPLAPLLRGTCAAMFGLFKAVYIDMRKCLGIFTSHINTT

SEQ ID NO: 1032882 - protein, 967 aa, Homo sapiens
MAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVARQLQDRRRKEAGGRKEEPTRLRQRSPGLPEKSRVPGLDCAGKDSSILEASAPLENKSHVEHLIRLQKQKLQLLPPPPPPPGPARGTANHTSASAAVTRLPQQSPQLTTVTAPRPRALLMGTTMANLQTRVSTSHLQGPRLTSALTYQMAQVAVATPPVVSVLAVVVLSARVTVLPSTQRDQCCDKAAAKSGR

SEQ ID NO: 1032883 - protein, 974 aa, Homo sapiens
MAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVARQLQDRRRKEAGGRKEEPTRLRQRSPGLPEKSRVPGLDCAGKDSSILEASAPLENKSHVEHLIRLQKQKLQLLPPPPPPPGPARGTANHTSASAAVTRLPQQSPQLTTVTAPRPRALLMGTTMANLQTRVSTSHLQGPRLTSALTYQMAQVAVATPPVVSVLAVVVLSARVTVLPSTQRDQCVGSRVMAQIDRPHRAFV

SEQ ID NO: 1032884 - protein, 103 aa, Homo sapiens
MCALHVSSEVDSTLLRCSAAVPELTTDPSAGPAPDKGLPALGVLCSVARKHGQPGTPVAIATQLPPRTSAAFPAQQQPLQVLSDGSTVQLPRLSSLGFEDSMC

SEQ ID NO: 1032885 - protein, 416 aa, Homo sapiens
MAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVRKRS

SEQ ID NO: 1032886 - protein, 534 aa, Homo sapiens
AGRRRGFHPPALLTRPERSPEAQGERHIGYRREVIMHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQVLSDGSTVQLPRLSSLGFEDSMC

SEQ ID NO: 1032887 - protein, 3106 aa, Homo sapiens
AGRRRGFHPPALLTRPERSPEAQGERHIGYRREVIMHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKGGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGMRQLGAWPVRELHRPWMMRRSDVIRFPGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032888 - protein, 2981 aa, Homo sapiens
MQHVSSSQSSQRHVQWPGACPGAGEEQPACSQPSLPLTLPSPSHQLQQLMDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032889 - protein, 3044 aa, Homo sapiens
MQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032890 - protein, 1826 aa, Homo sapiens
MLRVSFSTGSTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQAFTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQQTTTTSQVQVPQIQGQAQSPAQIKAVGKLTPEHLIKMQKQKLQMPPQPPPPQAQSAPPQPAAQVQVQTSQPPQQQSPQLTTVTAPRPGALLTGTTVANLQVARLTRVPTSQLQSQGQMQTQAPQPAQVPLAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 1032891 - protein, 2216 aa, Homo sapiens
AGRRRGFHPPALLTRPERSPEAQGERHIGYRREVIMHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKGGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDGVTPYMIFFKDGLENGKMLQCGIIWIYHPSSYWFCVITHTDLDNGGVICTLIMNGYGGELFKKTVVCPISF

SEQ ID NO: 1032892 - protein, 1960 aa, Homo sapiens
AGRRRGFHPPALLTRPERSPEAQGERHIGYRREVIMHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKGGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRVKACGGMDQEMQRHPHIQVKGL

SEQ ID NO: 1032893 - protein, 971 aa, Homo sapiens
MAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVARQLQDRRRKEAGGRKEEPTRLRQRSPGLPEKSRVPGLDCAGKDSSILEASAPLENKSHVEHLIRLQKQKLQLLPPPPPPPGPARGTANHTSASAAVTRLPQQSPQLTTVTAPRPRALLMGTTMANLQTRVSTSHLQGPRLTSALTYQMAQVAVATPPVVSVLAVVVLSARVTVLPSTQRDQCCDKAAAKSGSGQQI

SEQ ID NO: 1032894 - protein, 533 aa, Homo sapiens
MAPRRPVGLVGCSGLAARSAVAALIRAGSPWLRRPAAAGAFPEDVVMQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKERLYGPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPLSTCSSPLS

SEQ ID NO: 1032895 - protein, 3124 aa, Homo sapiens; identical to SEQ ID NO: 1032876

SEQ ID NO: 1032896 - protein, 3124 aa, Homo sapiens; identical to SEQ ID NO: 1032876

SEQ ID NO: 1032897 - protein, 101 aa, Homo sapiens
QPRAEHPKTVPQGKFGDPSVKLRGPRGAFPPGKLVKKIEISQHAKYTCSFCGKTKMKRRAVGIWHCGSCMKTVAGGAWTYNTTSAVTVKSAIRRLKELKDQ

SEQ ID NO: 1032898 - protein, 511 aa, Homo sapiens
VTLARSLQSRPVAMSADVTSSLAAFGEGWGVREALGSQQPPPSPRPGPAEPPEWTPQRLGSSLRKMVKKIEISQHAKYTCSFCFSPLLPPSGLMRQRGGCGACLGRTELSLGKTYFVNKWNTWLYSKKKQKKQKKTKKQKQNKTKKTTTTQHRKHNNTTQQTNNNINNKNNNKKRHDDERAAGGERGRATVKLHDKDVVSGAAGDGARRREKNGVRESQQQGMSAHIVTDEEHEARREGGRETTNKTRIQRRAGREPEREYSERGETIRDEEKAEESSVDDETLMALEETNRDKERPDRNNKNNKNTHEGSGERRGEDSTEDARTEAGGRGEREKRKREDSAGREGKRAQRKKEEEGGGDKETKRRRERKQGRERGTETGRKDEEGAGGGEERGGGRGPEGERGGRRGGEGQRRREQRGTRREKGAEAGGTTRRQGREKSEERRSGRGRGEETRARERRGRERQGAGRREEGDEGRDSQRNRRSADTAKHVRDRIGARQKQAGGEEEERRR

SEQ ID NO: 1032899 - protein, 107 aa, Homo sapiens
HALSVCLGSDLGRGDMAKRTKKVGIVGKYGTRYGASLRKMVKKIEISQHAKYTCSFCGKTKMKRRAVGIWHCGSCMKTVAGGAWTYNTTSAVTVKSAIRRLKELKDQ

SEQ ID NO: 1032900 - protein, 107 aa, Homo sapiens; identical to SEQ ID NO: 1032899

SEQ ID NO: 1032901 - protein, 107 aa, Homo sapiens; identical to SEQ ID NO: 1032899

SEQ ID NO: 1032902 - protein, 89 aa, Homo sapiens
HALSVCLGSDLGRGDMAKRTKKVGIVGKYGTRYGASLRKMVKKIEISQHAKYTCSFCGKTKMKRRAVGIWHCLHAGTTVDPHSSSLSSW

SEQ ID NO: 1032903 - protein, 153 aa, Homo sapiens
MAFHPAMALLLGLLYALLLGPGLGSNCLGLRAGGGGELRGTRLPFGPGVRFLFSLGLACGDMAKRTKKVGIVGKYGTRYGASLRKMVKKIEISQHAKYTCSFCGKTKMKRRAVGIWHCGSCMKTVAGGAWTYNTTSAVTVKSAIRRLKELKDQ

SEQ ID NO: 1032904 - protein, 418 aa, Homo sapiens
MRQRGGCGACLGRTELSLGKTYFVNKWNTWLYSKKKQKKQKKTKKQKQNKTKENNNNTAQKTQQHNTTNQQQHNNKNNNKKRHDDERAAGGERGRATVKLHDKDVVSGAAGDGARRREKNGVRESQQQGMSAHIVSHEEHEARREGGRETTNKTRIQRRAGREPEREYSERGETSATRKRLRISVDDETLMALEETNRDKERPDRNNKNNKNTHEGSGERRGEDSTEDARTEAGGRGEREKRKREDSAGREGKRAQRKKEEEGGGDKETKRRRERKQGRERGTETGRKDEEGAGGGEERGGGRGPEGERGGRRGGEGQRRREQRGTRREKGAEAGGTTRRQGREKSEERRSGRGRGEETRARERRGRERQGAGRREEGDEGRDSQRNRRSADTAKHVRDRIGARQKQAGGEEEERRRA

SEQ ID NO: 1032905 - protein, 107 aa, Homo sapiens; identical to SEQ ID NO: 1032899

SEQ ID NO: 1032906 - protein, 108 aa, Homo sapiens
MRCRCVWARTYVAATWPNVPRKSGSSVNTGPAMGPPSRAKVVKKIEISQHAKYTCSFCGKTKMKRRAVGIWHCGSCMKTVAGGAWTYNTTSAVTVKSAIRRLKELKDQ

SEQ ID NO: 1032907 - protein, 129 aa, Homo sapiens
HALSVCLGSDLGRGDMAKRTKKVGIVGKYGTRYGASLRKMVKKIEISQHAKYTCSFCGKTKMKRRAVGIWHCGSCMKTVAGGAWTYKKPKQDPNGTESATLMESKCSRPMERRLEITVDSHMAMDPKSD

SEQ ID NO: 1032908 - protein, 276 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTWHAQNLHFPFMNPKVVGGCQLPSWWSVQNAGDLESILSFIPPIANSPVVLHVMAHTSEAFSEM

SEQ ID NO: 1032909 - protein, 258 aa, Homo sapiens
MIHSLFLINSSGDIFLEKHWKSVVSRSVCDYFFEAQERATEAGHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTWHAQNLHFPFMNPKVVGGCQLPSWWSVQNAGDLESILSFIPPIANSPVVLHVMAHTSEAFSEM

SEQ ID NO: 1032910 - protein, 276 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTWHAQNLHFPFMNPKVVGGCQVPSWWSVQNAGDLESILSFIPPIANSPVVLHVMAHTSEAFSEM

SEQ ID NO: 1032911 - protein, 296 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYCSGISVLMQHTGPFASENDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTWHAQNLHFPFMNPKVVGGCQVPSWWSVQNAGDLESILSFIPPIANSPVVLHVMAHTSEAFSEM

SEQ ID NO: 1032912 - protein, 103 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQVRECGKVHICKP

SEQ ID NO: 1032913 - protein, 393 aa, Homo sapiens [sequence omitted]

SEQ ID NO: 1032914 - protein, 393 aa, Homo sapiens [sequence omitted]

SEQ ID NO: 1032915 - protein, 393 aa, Homo sapiens [sequence omitted]

SEQ ID NO: 1032916 - protein, 186 aa, Homo sapiens
MSRGLEEWDLHIGAVRSDAVSGGFRDFTGVRKVTFGNRLCLLPAKPAASGLELPPEPLPEVYQLTFGVAPASVEQAGSGFPAAAPQLRKARWHYSLRDSGIEGAEGAGLEEGSSLGPGPAPDTDTLSLLSLRTVASDLQKCDSVEHLRGLSDHVSLDGQELGTRSGGRRGSDGGARGGRHQRSVSL

SEQ ID NO: 1032917 - protein, 393 aa, Homo sapiens [sequence omitted]

SEQ ID NO: 1032918 - protein, 393 aa, Homo sapiens [sequence omitted]

SEQ ID NO: 1032919 - protein, 655 aa, Homo sapiens
MVTTLGPKMAAEWGGGVGYSGSGPGRSRWRWSGSVWVRSVLLLLGGLRASATSTPVSLGSSPPCRHHVPSDTEVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCEKKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 1032920 - protein, 655 aa, Homo sapiens; identical to SEQ ID NO: 1032919

SEQ ID NO: 1032921 - protein, 640 aa, Homo sapiens [sequence omitted]

SEQ ID NO: 1032922 - protein, 600 aa, Homo sapiens
MMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 1032923 - protein, 625 aa, Homo sapiens
GRGLWSRRPSGSSDPRPRRPASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 1032924 - protein, 555 aa, Homo sapiens
KLAAAGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKVLPC

SEQ ID NO: 1032925 - protein, 533 aa, Homo sapiens
KLAAAGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKDCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKVLPC

SEQ ID NO: 1032926 - protein, 555 aa, Homo sapiens; identical to SEQ ID NO: 1032924

SEQ ID NO: 1032927 - protein, 600 aa, Homo sapiens; identical to SEQ ID NO: 1032922

SEQ ID NO: 1032928 - protein, 555 aa, Homo sapiens; identical to SEQ ID NO: 1032924

SEQ ID NO: 1032929 - protein, 600 aa, Homo sapiens; identical to SEQ ID NO: 1032922

SEQ ID NO: 1032930 - protein, 555 aa, Homo sapiens; identical to SEQ ID NO: 1032924

SEQ ID NO: 1032931 - protein, 555 aa, Homo sapiens; identical to SEQ ID NO: 1032924

SEQ ID NO: 1032932 - protein, 123 aa, Homo sapiens
KLAAAGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIRYNFMILLLSFFTFQRI

SEQ ID NO: 1032933 - protein, 275 aa, Homo sapiens
GTRGPHSGPLSGPLAPVGWQQSVARHGGGRGWRWRLGRAGGKPGGRGGEAAALPGAPLHYLAPLLSNLSQRPAARAFLLDPDRCVVQRLLPLTQYPDSSVRRGGVVGTLRNCCFEHRHHEWLLGPEVDILPFLLLPLAGPEDFSEEEMERLPVDLQYLPPDKQREPDADIRKMLVEAIMLLTATAPGRQQVRDQGAYLILRELHSWEPEPDVRTACEKLIQVLIGDEPERGMENLLEVQVPEDVEQQLQQLDCREQEQLERELAPEPWVERATPT

SEQ ID NO: 1032934 - protein, 103 aa, Homo sapiens
MLVEAIMLVTATAPGRQQVRDQGAYLILRELHSWEPEPDVRTACEKLIQVLIGDEPERGMENLLEVQVPEDVEQQLQQLDCREQEQLERELAPEPWVERATPT

SEQ ID NO: 1032935 - protein, 103 aa, Homo sapiens; identical to SEQ ID NO: 1032934

SEQ ID NO: 1032936 - protein, 293 aa, Homo sapiens [sequence omitted]

SEQ ID NO: 1032937 - protein, 258 aa, Homo sapiens
MGEAGAGAGASGGPEASPEAEVVKLLPFLAPGARADLQAAAVRHVLALTGCGPGRALLAGQAALLQALMELAPASAPARDAARALVNLAADPGLHETLLAADPGLPARLMGRALDPQWPWAEEAAAALANLSREPAPCAALMAALAAAEPADSGLERLVRALCTPGYNARAPLHYLAPLLSNLSQRPAARAFLLDPDRVKPRAPARAGRGRKLGGTALSDTSQQVRGPAAAAPYPVPRLLCTQGRGGGDAAELLLRAP

SEQ ID NO: 1032938 - protein, 68 aa, Homo sapiens
MGGEGHTHLRPLQPDTSSRVPFARLSQTRPSCSCLQAPWVPLFRDCALLRSRATLRLSRNDRAANITT

SEQ ID NO: 1032939 - protein, 390 aa, Homo sapiens
MGEAGAGAGASGGPEASPEAEVVKLLPFLAPGARADLQAAAVRHVLALTGCGPGRALLAGQAALLQALMELAPASAPARDAARALVNLAADPGLHETLLAADPGLPARLMGRALDPQWPWAEEAAAALANLSREPAPCAALMAALAAAEPADSGLERLVRALCTPGYNARAPLHYLAPLLSNLSQRPAARAFLLDPDRCVVQRLLPLTQYPDSSVRRGGVVGTLRNCCFEHRHHEWLLGPEVDILPFLLLPLAGPEDFSEEEMERLPVDLQYLPPDKQREPDADIRKMLVEAIMLLTATAPGRQQVRDQGAYLILRELHSWEPEPDVRTACEKLIQVLIGDEPERGMENLLEVQVPEDVEQQLQQLDCREQEQLERELAPEPWVERATPT

SEQ ID NO: 1032940 - protein, 390 aa, Homo sapiens; identical to SEQ ID NO: 1032939

SEQ ID NO: 1032941 - protein, 538 aa, Homo sapiens
RRSSLGNKVGGWLGCEKRKKKREEKEEKGRTKKETRRNEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTNYNQFISFNGAGTSTNGSPVHLLSEGSFCHSC

SEQ ID NO: 1032942 - protein, 264 aa, Homo sapiens
MHVDGSAGKSEQQAKHVQTVEEDMQQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTNYNQFISFNGAGTSTNGSPVHLLSEGSFCHSC

SEQ ID NO: 1032943 - protein, 192 aa, Homo sapiens
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPPPVKKPGKKCTVF

SEQ ID NO: 1032944 - protein, 288 aa, Homo sapiens
SQWVGQASHLGLNPQPAPPSPAATLESGPLPGAPVWGALRPYSPPQPPEPGLPRSSSSLRSPRIWWAGSPSRPQTPLTRLWLRERGLPLLGRGSEAGPGSHVACPVRSAVGKTCLLISYTTNAFPGEYIPTVFDNYSANVMVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPPPVKKPGKKCTVF

SEQ ID NO: 1032945 - protein, 278 aa, Homo sapiens
LFCGGEMWYVSALEPGRGRAPPREPGMTHLSSSSLRSPRIWWAGSPSRPQTPLTRLWLRERGLPLLGRGSEAGPGSHVACPVRSAVGKTCLLISYTTNAFPGEYIPTVLSVEGFPGEHRPSVFDNYSANVMVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPPPVKKPGKKCTVF

SEQ ID NO: 1032946 - protein, 108 aa, Homo sapiens
LFCGGEMWYVSALEPGRGRAPPREPGMTHLSSSSLRSPRIWWAGSPSRPQTPLTRLWLRERGLPLLGRGSEAGPGSHVACPVRSAVGKTCLLISYTTNAFPGEYIPTV

SEQ ID NO: 1032947 - protein, 140 aa, Homo sapiens
RTREGAGPWGAPDHSTRSHLFPKDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPPPVKKPGKKCTVF

SEQ ID NO: 1032948 - protein, 189 aa, Homo sapiens
MLADQLHDQRLPRRVHPHRVSVEGFPGEHRPSVFDNYSANVMVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPPPVKKPGKKCTVF

SEQ ID NO: 1032949 - protein, 192 aa, Homo sapiens; identical to SEQ ID NO: 1032943

SEQ ID NO: 1032950 - protein, 73 aa, Homo sapiens
MSAETASGPTEDQVEILEYNFNKVDKHPDSTTLCLIAAEAGLSEEETQKWFKQRLAKWRRSEGLPSECRSVTD

SEQ ID NO: 1032951 - protein, 152 aa, Homo sapiens
SGVFEGDLKLYHPSPYLSLLTVLYVYILCPKENNLSLIGQLSRLLAWHPALRAVKSTAPDLRFEMRQHLTGNSLKRAGTMSAETASGPTEDQVEILEYNFNKVDKHPDSTTLCLIAAEAGLSEEETQKWFKQRLAKWRRSEGLPSECRSVTD

SEQ ID NO: 1032952 - protein, 117 aa, Homo sapiens
SGVFEGDLKLYHPSPYLSLLTVLYVYILCPKENNLSLIGQLSRLLAWHPALRAVKSTAPDLRFEMRQHLTGNSLKVRKWMKRLRVPFLFPVFSQPHLSYPILVKKLAWLGERSGTRR

SEQ ID NO: 1032953 - protein, 117 aa, Homo sapiens; identical to SEQ ID NO: 1032952

SEQ ID NO: 1032954 - protein, 104 aa, Homo sapiens
SGLRQKAAYRGGRLAADSGEPTLAICQRAGTMSAETASGPTEDQVEILEYNFNKVDKHPDSTTLCLIAAEAGLSEEETQKWFKQRLAKWRRSEGLPSECRSVTD

SEQ ID NO: 1032955 - protein, 152 aa, Homo sapiens
SGLRQKAAYRGGRLAADSGEPTLAICQVCPQGRSPFREEVFKGISQNHPRASFTPSLEPEVGEGPRNHLSRPRLQRAGTMSAETASGPTEDQVEILEYNFNKVDKHPDSTTLCLIAAEAGLSEEETQKWFKQRLAKWRRSEGLPSECRSVTD

SEQ ID NO: 1032956 - protein, 103 aa, Homo sapiens
ICDFTIENKTKKNCVVDDSLNPPGLHRAGTMSAETASGPTEDQVEILEYNFNKVDKHPDSTTLCLIAAEAGLSEEETQKWFKQRLAKWRRSEGLPSECRSVTD

SEQ ID NO: 1032957 - protein, 117 aa, Homo sapiens; identical to SEQ ID NO: 1032952

SEQ ID NO: 1032958 - protein, 117 aa, Homo sapiens; identical to SEQ ID NO: 1032952

SEQ ID NO: 1032959 - protein, 73 aa, Homo sapiens
MSAETASGPTEDQVEILEYNFNKVDKHPDSTTLCLIAAEAGLSEEETQKWFKQRLAKWRRSEGLPSECRSVID

SEQ ID NO: 1032960 - protein, 73 aa, Homo sapiens; identical to SEQ ID NO: 1032950

SEQ ID NO: 1032961 - protein, 73 aa, Homo sapiens; identical to SEQ ID NO: 1032950

SEQ ID NO: 1032962 - protein, 117 aa, Homo sapiens; identical to SEQ ID NO: 1032952

SEQ ID NO: 1032963 - protein, 117 aa, Homo sapiens; identical to SEQ ID NO: 1032952

SEQ ID NO: 1032964 - protein, 163 aa, Homo sapiens
LPFTPWPGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPWINGKYRA

SEQ ID NO: 1032965 - protein, 792 aa, Homo sapiens
SWYGRRFKDQSRSSRRRPRRAQFAVRAGSHPGPTPTRPGQAPYSVATMEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1032966 - protein, 792 aa, Homo sapiens; identical to SEQ ID NO: 1032965

SEQ ID NO: 1032967 - protein, 218 aa, Homo sapiens
MAAELFIQCNQTQSMIIVLPGPVLDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1032968 - protein, 792 aa, Homo sapiens; identical to SEQ ID NO: 1032965

SEQ ID NO: 1032969 - protein, 165 aa, Homo sapiens
GGSQRGGKACKEGAVLGPGRLGQHVVCSGVRGPEAVAVGVDGVVSIHVHVHLQRVKGHIAGVHGAVGGIQVISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1032970 - protein, 792 aa, Homo sapiens; identical to SEQ ID NO: 1032965

SEQ ID NO: 1032971 - protein, 104 aa, Homo sapiens
VLCGCVCEWGGQLQLMPIPRTCEVHSAVMGGVVAMSKAPVPCPLPPLTQDGVRMEEIVEGCTGALHILARDPMNRMEIFRLNTIPLFVQVSLGQVGRRGPPTTA

SEQ ID NO: 1032972 - protein, 759 aa, Homo sapiens
GLTHDTPNGAGKGDSTTHRLGMQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1032973 - protein, 792 aa, Homo sapiens; identical to SEQ ID NO: 1032965

SEQ ID NO: 1032974 - protein, 792 aa, Homo sapiens; identical to SEQ ID NO: 1032965

SEQ ID NO: 1032975 - protein, 792 aa, Homo sapiens; identical to SEQ ID NO: 1032965

SEQ ID NO: 1032976 - protein, 792 aa, Homo sapiens; identical to SEQ ID NO: 1032965

SEQ ID NO: 1032977 - protein, 792 aa, Homo sapiens; identical to SEQ ID NO: 1032965

SEQ ID NO: 1032978 - protein, 792 aa, Homo sapiens; identical to SEQ ID NO: 1032965

SEQ ID NO: 1032979 - protein, 404 aa, Homo sapiens
SWYGRRFKDQSRSSRRRPRRAQFAVRAGSHPGPTPTRPGQAPYSVATMEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTRRGLLLVRCLPRACIPPASTMAGLLL

SEQ ID NO: 1032980 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1032981 - protein, 493 aa, Homo sapiens
NHAAPSTIASWSRGLPWPPYFGLRRVLPGSEGPRERLMSWREEMWGLEPSLGSDPATSCVSVGKFPNLSEPHCLTCTTDSNALSQGVAGHRDESSRAHTGRADPFRSSHSPWTYSRRLPGVGCSLTPPPFLALQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1032982 - protein, 165 aa, Homo sapiens
HFGEAVSLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 1032983 - protein, 792 aa, Homo sapiens; identical to SEQ ID NO: 1032965

SEQ ID NO: 1032984 - protein, 700 aa, Homo sapiens
SWYGRRFKDQSRSSRRRPRRAQFAVRAGSHPGPTPTRPGQAPYSVATMEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSPKRVLLPSPLHWYRHDS

SEQ ID NO: 1032985 - protein, 327 aa, Homo sapiens [sequence omitted]

SEQ ID NO: 1032986 - protein, 1061 aa, Homo sapiens
RAATQGRAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQARSSSAWWS

SEQ ID NO: 1032987 - protein, 1013 aa, Homo sapiens
NLRLVRGWVVIGRGTLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQARSSSAWWS

SEQ ID NO: 1032988 - protein, 859 aa, Homo sapiens
MELADHLVKRAAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRFQPVSPLWW

SEQ ID NO: 1032989 - protein, 1065 aa, Homo sapiens
MELADHLVKRAAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQARSSSAWWS

SEQ ID NO: 1032990 - protein, 167 aa, Homo sapiens
FQCFLSCGAGLAPSGWLGWGGQRSAWALQFWSGPLSVSDLLEVLSDIDEMSRRRPEILSFFSTNLQRLMSSAEECCRNLAFSLALRSMQNSPSIAAAFLPTFMYCLGSQDFEVVQTALRNLPEYALLCQEHAAVLLHRAFLVGMYGQMDPSAQISEALRILHMEAVM

SEQ ID NO: 1032991 - protein, 1065 aa, Homo sapiens; identical to SEQ ID NO: 1032989

SEQ ID NO: 1032992 - protein, 1030 aa, Homo sapiens
LRGELRQEEAAALSDGLLGGRGRQVPLEGQDSLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQARSSSAWWS

SEQ ID NO: 1032993 - protein, 897 aa, Homo sapiens
TEISECVSGCYCHHEGRGVVLVAISAVGGQFPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQARSSSAWWS

SEQ ID NO: 1032994 - protein, 327 aa, Homo sapiens [sequence omitted]

SEQ ID NO: 1032995 - protein, 514 aa, Homo sapiens
NLRLVRGWVVIGRGTLCLSGLPLGLHPCSSHLAGAGPAHPAEAAGGAGAAGPGPELISLVELILAEAETRSQDGDTAACSLIQARLPLLLSCCCGDDESVRKVTEHLSGCIQQWGDSVLGRRCRDLLLQLYLQRPELRVPVPEVLLHSEGAASSSVCKLDGLIHRFITLLADTSDSRALENRGADASMACRKLAVAHPLLLLRHLPMIAALLHGRTHLNFQEFRQQNHLSCFLHVLGLLELLQPHVFRSEHQGALWDCLLSFIRLLLNYRKSSRHLAAFINKFVQFIHKYITYNAPAAISFLQKHADPLHDLSFDNSDLVMLKSLLAGLSLPSRDDRTDRGLDEEGEEESSAGSLPLVSVSLFTPLTAAEMAPYMKRLSRGQTVEDLLEVLSDIDEMSRRRPEILSFFSTNLQRLMSSAEECCRNLAFSLALRSMQNSPSIAAAFLPTFMYCLGSQDFEVVQTALRNLPEYALLCQEHAAVLLHRAFLVGMYGQMDPSAQISEALRILHMEAVM

SEQ ID NO: 1032996 - protein, 104 aa, Homo sapiens
LRGDLRDCQDSQQIKEQKFVHFLAQDKSPSIAAAFLPTFMYCLGSQDFEVVQTALRNLPEYALLCQEHAAVLLHRAFLVGMYGQMDPSAQISEALRILHMEAVM

SEQ ID NO: 1032997 - protein, 576 aa, Homo sapiens
MHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQARSSSAWWS

SEQ ID NO: 1032998 - protein, 1065 aa, Homo sapiens; identical to SEQ ID NO: 1032989

SEQ ID NO: 1032999 - protein, 110 aa, Homo sapiens
MVKIMKAVTIQLEAESQQLLGNVTLGGRWGGSGLASPVGRPLKFVIRPLFQRDVNWSEKEIFHLRKLLVLNAGWYLGMCLEIEISRVFALEPAPQEAFSRDKAKVEILHG

SEQ ID NO: 1033000 - protein, 110 aa, Homo sapiens; identical to SEQ ID NO: 1032999

SEQ ID NO: 1033001 - protein, 110 aa, Homo sapiens; identical to SEQ ID NO: 1032999

SEQ ID NO: 1033002 - protein, 177 aa, Homo sapiens [sequence omitted]

SEQ ID NO: 1033003 - protein, 123 aa, Homo sapiens
MLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 1033004 - protein, 123 aa, Homo sapiens; identical to SEQ ID NO: 1033003

SEQ ID NO: 1033005 - protein, 123 aa, Homo sapiens; identical to SEQ ID NO: 1033003

SEQ ID NO: 1033006 - protein, 168 aa, Homo sapiens
MAEGARARGPRGCRDRDGPAGGAGKMAAPRRGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 1033007 - protein, 123 aa, Homo sapiens; identical to SEQ ID NO: 1033003

SEQ ID NO: 1033008 - protein, 229 aa, Homo sapiens
MAEGARARGPRGCRDRDGPAGGAGKMAAPRRGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTRGFGGEVRAKAGDETAGERAAEGHIRSLRPLQFYQLLPFARSAKQILALCFFPIPRFTISSP

SEQ ID NO: 1033009 - protein, 178 aa, Homo sapiens
MAEGARARGPRGCRDRDGPAGGAGKMAAPRRGELGRGGGFPGLQRRARRSPCGDNPVSAFGALTGPCHRLYVERDSSRHPIEEGAALALAWVAGVLHPEEAPPARGRLAPGRVGAERSGGPVPGGLVRACFVKTRGGMGAVRELDSGKEIGGRCSASAEDSSEGRTPRNGTKALCGSQ

SEQ ID NO: 1033010 - protein, 107 aa, Homo sapiens
MAEGARARGPRGCRDRDGPAGGAGKMAAPRRGRGSSTVLSSVPLQMLFYLSGTYYALYFLATLLMITYKSQVFSYPHRYLVLDLALLFLMGILEAVRLYLGEWTVTP

SEQ ID NO: 1033011 - protein, 123 aa, Homo sapiens; identical to SEQ ID NO: 1033003

SEQ ID NO: 1033012 - protein, 123 aa, Homo sapiens; identical to SEQ ID NO: 1033003

SEQ ID NO: 1033013 - protein, 123 aa, Homo sapiens; identical to SEQ ID NO: 1033003

SEQ ID NO: 1033014 - protein, 177 aa, Homo sapiens [sequence omitted]

SEQ ID NO: 1033015 - protein, 168 aa, Homo sapiens; identical to SEQ ID NO: 1033006

SEQ ID NO: 1033016 - protein, 229 aa, Homo sapiens; identical to SEQ ID NO: 1033008

SEQ ID NO: 1033017 - protein, 111 aa, Homo sapiens
MAEGARARGPRGCRDRDGPAGGAGKMAAPRRGRGSSTVVSCCVPLQDSTQRPELLLGERALGLTPRFPKVLSSNSTLERGVFLDRFRELMELPRISSAGSIPYLLSPAQSG

SEQ ID NO: 1033018 - protein, 123 aa, Homo sapiens; identical to SEQ ID NO: 1033003

SEQ ID NO: 1033019 - protein, 123 aa, Homo sapiens; identical to SEQ ID NO: 1033003

SEQ ID NO: 1033020 - protein, 123 aa, Homo sapiens; identical to SEQ ID NO: 1033003

SEQ ID NO: 1033021 - protein, 123 aa, Homo sapiens; identical to SEQ ID NO: 1033003

SEQ ID NO: 1033022 - protein, 123 aa, Homo sapiens; identical to SEQ ID NO: 1033003

SEQ ID NO: 1033023 - protein, 123 aa, Homo sapiens; identical to SEQ ID NO: 1033003

SEQ ID NO: 1033024 - protein, 218 aa, Homo sapiens
AEGTCLRFSPLMAAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQARSLLKGPCEVQML

SEQ ID NO: 1033025 - protein, 337 aa, Homo sapiens
AEGTCLRFSPLMAAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 1033026 - protein, 337 aa, Homo sapiens; identical to SEQ ID NO: 1033025

SEQ ID NO: 1033027 - protein, 337 aa, Homo sapiens; identical to SEQ ID NO: 1033025

SEQ ID NO: 1033028 - protein, 337 aa, Homo sapiens; identical to SEQ ID NO: 1033025

SEQ ID NO: 1033029 - protein, 383 aa, Homo sapiens
AEGTCLRFSPLMAAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQMGKPGCRDLRLTQPVNSPLLVFACHLGATRNPHVEMVSRSTVLYEVVLSLHHKC

SEQ ID NO: 1033030 - protein, 337 aa, Homo sapiens; identical to SEQ ID NO: 1033025

SEQ ID NO: 1033031 - protein, 337 aa, Homo sapiens; identical to SEQ ID NO: 1033025

SEQ ID NO: 1033032 - protein, 362 aa, Homo sapiens
SLFCISLNRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDNTLKLWDYSKGKCLKTYTGHKNEKYCIFANFSVTGGKWIVSGSEDNLVYIWNLQTKEIVQKLQGHTDVVISTACHPTENIIASAALENDKTIKLWKSDC

SEQ ID NO: 1033033 - protein, 956 aa, Homo sapiens
SLFCISLNRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDKEYCVGLWGRACGLPSQRHLRASVSLWRACCGLGTGSRLLVELRLLGSGLLGRRAGPRPSLPEAEPQVRAIGGFRVRFLVEQLWPGQAQPSRMKESAVRGPPRPFLVLTSEHLDFTSHKATALLGCSLSSSFPMLCTLSPVGPSLGPDPLRAVWLGGKTCSGCFQNQEDFLTLLRMTRVRDDNTHQLPVKVSLGTTNTCGCHTVLSDAKSLDFEPEGLLTLMGKGVPAPLAFAPGADGGCDVVAAELGVGTEGCLQTCRLTPLSVLQHSEALGLQQGEGEPPQAWAPMVHHPWVMASGGDRAGPGDDKGEELREPSPLGLVRIPERPGYLEGGSLQVKSSIVWVWYLYFSEISEVSSETPCLEVELHKIKGNHDSVTSLPLLFQCLKTYTGHKNEKYCIFANFSVTGGKWIVSGSEDNLVYIWNLQTKEIVQKLQGHTGEGLRSCSHWLPVDVRTVPAGEAWCARRVLSSSPSHLSPPLAPLRNRCYRALAQGMELVTVLPTQTRAPGLNPVSPCSARHAGPEGVCGCGTLGGCSPSHVTASSVSWAGDSEVIAAPSWRLWLLSGTCSLSQRDPPAACRPSGLHGGAGSQATWGCHLCGSRLPSAAAATSSPSGPAFPRLMEPTRAGGSSPCGNLGRHCFSLHVSSFTQPGVSAYAPRRAWAFPWVLAGVLGFFGLRRSCKHFDVADLAPPVC

SEQ ID NO: 1033034 - protein, 255 aa, Homo sapiens
MESGWQVHLLINLLKFGARMMGNLRKPYDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDNTLKLWDYSKGKCLKTYTGHKNEKYCIFANFSVTGGKWIVSGSEDNLVYIWNLQTKEIVQKLQGHTDVVISTACHPTENIIASAALENDKTIKLWKSDC

SEQ ID NO: 1033035 - protein, 334 aa, Homo sapiens
MATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDNTLKLWDYSKGKCLKTYTGHKNEKYCIFANFSVTGGKWIVSGSEDNLVYIWNLQTKEIVQKLQGHTDVVISTACHPTENIIASAALENDKTIKLWKSDC

SEQ ID NO: 1033036 - protein, 117 aa, Homo sapiens
ISRLVLFDKHLSSPYLSPMLKNIQGVCAYDRRDARGHTGQANALITLAILTLWGAFLVVFIYGKPCTGGVYLCHLGKQAVWHILAHPALQPMKEALKTLRWGKVLAVWIHRPSKELP

SEQ ID NO: 1033037 - protein, 1247 aa, Homo sapiens
MRSPAPVTVGVLGIAPANSAASTFPESTAIGIPLPPKLWTGHEGAKCFPGCLLRGHQHSCHGPFVHRMPVALPPQGSAVHSKALRSEAGRRECAVVEARGPGLSFSFKPLSPPLGTTPLYLEVKMPAQEGRAGPRRARCEVSLRTAERARVTPERPCQSAGLAGSRFVHRGLCACRGGKSPQPGSRPRGKAQPGLPNPVNAQVPGLPDGQESSCPPGVGGHMGALRPGAAPGAFQMPTAALIRTSDDQEGAWSPGEVPRPESTPETTPGDATCAGPGGPLVSVYRACCLWKREGTLALSRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDKEYCVGLWGRACGLPSQRHLRASVSLWRACCGLGTGSRLLVELRLLGSGLLGRRAGPRPSLPEAEPQVRAIGGFRVRFLVEQLWPGQAQPSRMKESAVRGPPRPFLVLTSEHLDFTSHKATALLGCSLSSSFPMLCTLSPVGPSLGPDPLRAVWLGGKTCSGCFQNQEDFLTLLRMTRVRDDNTHQLPVKVSLGTTNTCGCHTVLSDAKSLDFEPEGLLTLMGKGVPAPLAFAPGADGGCDVVAAELGVGTEGCLQTCRLTPLSVLQHSEALGLQQGEGEPPQAWAPMVHHPWVMASGGDRAGPGDDKGEELREPSPLGLVRIPERPGYLEGGSLQVKSSIVWVWYLYFSEISEVSSETPCLEVELHKIKGNHDSVTSLPLLFQCLKTYTGHKNEKYCIFANFSVTGGKWIVSGSEDNLVYIWNLQTKEIVQKLQGHTGEGLRSCSHWLPVDVRTVPAGEAWCARRVLSSSPSHLSPPLAPLRNRCYRALAQGMELVTVLPTQTRAPGLNPVSPCSARHAGPEGVCGCGTLGGCSPSHVTASSVSWAGDSEVIAAPSWRLWLLSGTCSLSQRDPPAACRPSGLHGGAGSQATWGCHLCGSRLPSAAAATSSPSGPAFPRLMEPTRAGGSSPCGNLGRHCFSLHVSSFTQPGVSAYAPRRAWAFPWVLAGVLGFFGLRRSCKHFDVADLAPPVC

SEQ ID NO: 1033038 - protein, 997 aa, Homo sapiens
PGGPLTRPEAPALVSSFPQASVPGLTSPLSLHCPFREGPQTHQATQSLDRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDKEYCVGLWGRACGLPSQRHLRASVSLWRACCGLGTGSRLLVELRLLGSGLLGRRAGPRPSLPEAEPQVLTIGGFRVRFLVEQLWPGQAQPSRMKESAVRGPPRPFLVLTSEHLDFTSHKATALLGCSLSSSFPMLCTLSPVGPSLGPDPLRAVWLGGKTCSGCFQNQEDFLTLLRMTRVRDDNTHQLPVKVSLGTTNTCGCHTVLSDAKSLDFEPEGLLTLMGKGVPAPLAFAPGADGGCDVVAAELGVGTEGCLQTCRLTPLSVLQHSEALGLQQGEGEPPQAWAPMVHHPWVMASGGDRAGPGDDKGEELREPSPLGLVRIPERPGYLEGGSLQVKSSIVWVWYLYFSEISEVSSETPCLEVELHKIKGNHDSVTSLPLLFQCLKTYTGHKNEKYCIFANFSVTGGKWIVSGSEDNLVYIWNLQTKEIVQKLQGHTGEGLRSCSHWLPVDVRTVPAGEAWCARRVLSSSPSHLSPPLAPLRNRCYRALAQGMELVTVLPTQTRAPGLNPVSPCSARHAGPEGVCGCGTLGGCSPSHVTASSVSWAGDSEVIAAPSWRLWLLSGTCSLSQRDPPAACRPSGLHGGAGSQATWGCHLCGSRLPSAAAATSSPSGPAFPRLMEPTRAGGSSPCGNLGRHCFSLHVSSFTQPGVSAYAPRRAWAFPWVLAGVLGFFGLRRSCKHFDVADLAPPVC

SEQ ID NO: 1033039 - protein, 393 aa, Homo sapiens
SVAAWSPPELPPCRAESALPPRRRPTRRPERPAPPPRPGRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDNTLKLWDYSKGKCLKTYTGHKNEKYCIFANFSVTGGKWIVSGSEDNLVYIWNLQTKEIVQKLQGHTDVVISTACHPTENIIASAALENDKTIKLWKSDC

SEQ ID NO: 1033040 - protein, 422 aa, Homo sapiens
RNAVTSSGNRWFLGIAPANSAASTFPESTAIGIPLPPKLWTGHEGAKCFPGCLLRGHQHSCHGPFVHRMPVALPPQGSAVHSKALRSEAGRRECAVVEARGPGLSFSFKPLSPPLGTTPLYLEVKMPAQEGRAGPRRARCEVSLRTAERARVTPERPCQSAGLAGSRFVHRGLCACRGGKSPQPGSRPRGKAQPGLPNPVNAQVPGLPDGQESSCPPGVGGHMGALRPGAAPGAFQMPTAALIRTSDDQEGAWSPGEVPRPESTPETTPGDATCAGPGGPLVSVYRACCLWKREGTLALSRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGTFRRKRLYRNYKATQMS

SEQ ID NO: 1033041 - protein, 393 aa, Homo sapiens; identical to SEQ ID NO: 1033039

SEQ ID NO: 1033042 - protein, 334 aa, Homo sapiens; identical to SEQ ID NO: 1033035

SEQ ID NO: 1033043 - protein, 334 aa, Homo sapiens; identical to SEQ ID NO: 1033035

SEQ ID NO: 1033044 - protein, 987 aa, Homo sapiens
SVAAWSPPELPPCRAESALPPRRRPTRRPERPAPPPRPGRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDKEYCVGLWGRACGLPSQRHLRASVSLWRACCGLGTGSRLLVELRLLGSGLLGRRAGPRPSLPEAEPQVRAIGGFRVRFLVEQLWPGQAQPSRMKESAVRGPPRPFLVLTSEHLDFTSHKATALLGCSLSSSFPMLCTLSPVGPSLGPDPLRAVWLGGKTCSGCFQNQEDFLTLLRMTRVRDDNTHQLPVKVSLGTTNTCGCHTVLSDAKSLDFEPEGLLTLMGKGVPAPLAFAPGADGGCDVVAAELGVGTEGCLQTCRLTPLSVLQHSEALGLQQGEGEPPQAWAPMVHHPWVMASGGDRAGPGDDKGEELREPSPLGLVRIPERPGYLEGGSLQVKSSIVWVWYLYFSEISEVSSETPCLEVELHKIKGNHDSVTSLSLLFQCLKTYTGHKNEKYCIFANFSVTGGKWIVSGSEDNLVYIWNLQTKEIVQKLQGHTGEGLRSCSHWLPVDVRTVPAGEAWCARRVLSSSPSHLSPPLAPLRNRCYRALAQGMELVTVLPTQTRAPGLNPVSPCSARHAGPEGVCGCGTLGGCSPSHVTASSVSWAGDSEVIAAPSWRLWLLSGTCSLSQRDPPAACRPSGLHGGAGSQATWGCHLCGSRLPSAAAATSSPSGPAFPRLMEPTRAGGSSPCGNLGRHCFSLHVSSFTQPGVSAYAPRRAWAFPWVLAGVLGFFGLRRSCKHFDVADLAPPVC

SEQ ID NO: 1033045 - protein, 1123 aa, Homo sapiens
MPAQEGRAGPRRARCEVSLRTAERARVTPERPCQSAGLAGSRFVHRGLCACRGGKSPQPGSRPRGKAQPGLPNPVNAQVPGLPDGQESSCPPGVGGHMGALRPGAAPGAFQMPTAALIRTSDDQEGAWSPGEVPRPESTPETTPGDATCAGPGGPLVSVYRACCLWKREGTLALSRLPLSPGPSTLVSCAASVRAMATEEKKPETEAARAQPTPSSSATQSKPTPVKPNYALKFTLAGHTKAVSSVKFSPNGEWLASSSADKLIKIWGAYDGKFEKTISGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDKSVLRGTVGAGMWPPQPETPACQREPLESVLWAWHGIQAPGGASASGQWPVRSEGRPPSIPSRGCTSGPTIGGFRVRFLVEQLWPGQAQPSRMKESAVRGPPRPFLVLTSEHLDFTSHKATALLGCSLSSSFPMRAPSALWVRAWALILLRAVWLGGKTCSGCFQNQEDFLTLLRMTRVRDDNTHQLPVKVSLGTTNTCGCHTVLSDAKSLDFEPEGLLTLMGKGVPAPLAFAPGADGGCDVVAAELGVGTEGCLQTCRLTPLSVLQHSEALGLQQGEGEPPQAWAPMVHHPWVMASGGDRAGPGDDKGEELREPSPLGLVRIPERPGYLEGGSLQVKSSIVWVWYLYFSEISEVSSETPCLEVELHKIKGNHDSVTSLPLLFQCLKTYTGHKNEKYCIFANFSVTGGKWIVSGSEDNLVYIWNLQTKEIVQKLQGHTGEGLRSCSHWLPVDVRTVPAGEAWCARRVLSSSPSHLSPPLAPLRNRCYRALAQGMELVTVLPTQTRAPGLNPVSPCSARHAGPEGVCGCGTLGGCSPSHVTASSVSWAGDSEVIAAPSWRLWLLSGTCSLSQRDPPAACRPSGLHGGAGSQATWGCHLCGSRLPSAAAATSSPSGPAFPRLMEPTRAGGSSPCGNLGRHCFSLHVSSFTQPGVSAYAPRRAWAFPWVLAGVLGFFGLRRSCKHFDVADLAPPVC

SEQ ID NO: 1033046 - protein, 869 aa, Homo sapiens
MGMFEILTFCRWSYFVLSVTDPVLSGHKLGISDVAWSSDSNLLVSASDDKTLKIWDVSSGKCLKTLKGHSNYVFCCNFNPQSNLIVSGSFDESVRIWDVKTGKCLKTLPAHSDPVSAVHFNRDGSLIVSSSYDGLCRIWDTASGQCLKTLIDDDNPPVSFVKFSPNGKYILAATLDKEYCVGLWGRACGLPSQRHLRASVSLWRACCGLGTGSRLLVELRLLGSGLLGRRAGPRPSLPEAEPQVRAIGGFRVRFLVEQLWPGQAQPSRMKESAVRGPPRPFLVLTSEHLDFTSHKATALLGCSLSSSFPMLCTLSPVGPSLGPDPLRAVWLGGKTCSGCFQNQEDFLTLLRMTRVRDDNTHQLPVKVSLGTTNTCGCHTVLSDAKSLDFEPEGLLTLMGKGVPAPLAFAPGADGGCDVVAAELGVGTEGCLQTCRLTPLSVLQHSEALGLQQGEGEPPQAWAPMVHHPWVMASGGDRAGPGDDKGEELREPSPLGLVRIPERPGYLEGGSLQVKSSIVWVWYLYFSEISEVSSETPCLEVELHKIKGNHDSVTSLPLLFQCLKTYTGHKNEKYCIFANFSVTGGKWIVSGSEDNLVYIWNLQTKEIVQKLQGHTGEGLRSCSHWLPVDVRTVPAGEAWCARRVLSSSPSHLSPPLAPLRNRCYRALAQGMELVTVLPTQTRAPGLNPVSPCSARHAGPEGVCGCGTLGGCSPSHVTASSVSWAGDSEVIAAPSWRLWLLSGTCSLSQRDPPAACRPSGLHGGAGSQATWGCHLCGSRLPSAAAATSSPSGPAFPRLMEPTRAGGSSPCGNLGRHCFSLHVSSFTQPGVSAYAPRRAWAFPWVLAGVLGFFGLRRSCKHFDVADLAPPVC

SEQ ID NO: 1033047 - protein, 393 aa, Homo sapiens; identical to SEQ ID NO: 1033039

SEQ ID NO: 1033048 - protein, 393 aa, Homo sapiens; identical to SEQ ID NO: 1033039

SEQ ID NO: 1033049 - protein, 170 aa, Homo sapiens
GASGAAAYGADMAKSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKAKAKAKAKDQTKAQAAAPASVPAQAPKRTQAPTKASE

SEQ ID NO: 1033050 - protein, 170 aa, Homo sapiens; identical to SEQ ID NO: 1033049

SEQ ID NO: 1033051 - protein, 74 aa, Homo sapiens
GASGAAAYGADMAKSKNHTTHNQFRKLDKNGIKEPRLQRYGSFKGVGPKVPRDMRFGKKDTHKGAHEGSGPHFP

SEQ ID NO: 1033052 - protein, 170 aa, Homo sapiens; identical to SEQ ID NO: 1033049

SEQ ID NO: 1033053 - protein, 169 aa, Homo sapiens
LQATSRNPQNMTQSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKAKAKAKAKDQTKAQAAAPASVPAQAPKRTQAPTKASE

SEQ ID NO: 1033054 - protein, 158 aa, Homo sapiens
NSKDAPTEHDQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKAKAKAKAKDQTKAQAAAPASVPAQAPKRTQAPTKASE

SEQ ID NO: 1033055 - protein, 166 aa, Homo sapiens
GASGAAAYGADMAKSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLAPVLGPPKTQPYTMSRLIAMTGGKSWQPTGLGANPDTSVPTVVCPWPCKDR

SEQ ID NO: 1033056 - protein, 69 aa, Homo sapiens
GASGAAAYGADMAKSKNHTTHNQSRKWHRNGIKKPRSQRYESLKGRVTCTESHGQCLVLVPGAQSRPLM

SEQ ID NO: 1033057 - protein, 51 aa, Homo sapiens
AAGDLEEPTEHDPPVPKMAQKWYQETPITKIPFLCHFRDWLCVVWFLDWVM

SEQ ID NO: 1033058 - protein, 170 aa, Homo sapiens; identical to SEQ ID NO: 1033049

SEQ ID NO: 1033059 - protein, 173 aa, Homo sapiens
GASGAAAYGADMAKSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKAKAQTGVSDSRLVHDGMCIIRMRAGGPNRRSAVALIGVTL

SEQ ID NO: 1033060 - protein, 173 aa, Homo sapiens
MYTWLIPERLSPHRQVPTLAIPTADQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKAKAKAKAKDQTKAQAAAPASVPAQAPKRTQAPTKASE

SEQ ID NO: 1033061 - protein, 152 aa, Homo sapiens
MSQSRRGVQSSGLDVGADESWYGTTLGVDPKFLRNMRFAKKHNKKGLKKMQANNAKAMSARAEAIKALVKPKEVKPKIPKGVSRKLDRLAYIAHPKLGKRARARIAKGLRLCRPKAKAKAKAKDQTKAQAAAPASVPAQAPKRTQAPTKASE

SEQ ID NO: 1033062 - protein, 170 aa, Homo sapiens; identical to SEQ ID NO: 1033049

SEQ ID NO: 1033063 - protein, 145 aa, Homo sapiens
DLEDHPVRSTEPQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKAKAKAKAKDQTKAQAAAPASVPAQAPKRTQAPTKASE

SEQ ID NO: 1033064 - protein, 97 aa, Homo sapiens
GASGAAAYGADMAKSKNHTTHNQSRKWHRNGIKKPRSQRYESLKGVDPKFLRNMRFAKKHNKKGLKKMQANNAKAMSARAEAIKALVKPKEVKPKIP

SEQ ID NO: 1033065 - protein, 119 aa, Homo sapiens
MTQQGAALQNYNNELVKCIEELCQKREELCRQIQEEEDEKQRLQNEVRQLTEKLARVNENLARKIASRNEFDRTIAETEAAYLKILESSQTLLSVLKREAGNLTKATAPDQKSSGGRDS

SEQ ID NO: 1033066 - protein, 83 aa, Homo sapiens
MTQQGAALQNYNNELVKCERRSRDGEVGRAAGPGSRLAAGCPWTRLAAGIARLSRALRAGGRVSVARALAGSQAPRRALGGGA

SEQ ID NO: 1033067 - protein, 119 aa, Homo sapiens; identical to SEQ ID NO: 1033065

SEQ ID NO: 1033068 - protein, 193 aa, Homo sapiens
MTRYRGRYSLVRASMDRPSRGCPDRCGHRAAEQSPPCRRPGVRGPSPRWLAGPAPGARGWCLTLASSGGRRPALRRRAPALGPQRRPSRPPGIEELCQKREELCRQIQEEEDEKQRLQNEVRQLTEKLARVNENLARKIASRNEFDRTIAETEAAYLKILESSQTLLSVLKREAGNLTKATAPDQKSSGGRDS

SEQ ID NO: 1033069 - protein, 111 aa, Homo sapiens
RAVGESCAGADSAASAAVGVVGPRAALTMTQQGAALQNYNNELVKCERRSRDGEVGRAAGPGSRLAAGCPWTRLAAGIARLSRALRAGGRVSVARALAGSQAPRRALGGGA

SEQ ID NO: 1033070 - protein, 83 aa, Homo sapiens; identical to SEQ ID NO: 1033066

SEQ ID NO: 1033071 - protein, 111 aa, Homo sapiens; identical to SEQ ID NO: 1033069

SEQ ID NO: 1033072 - protein, 87 aa, Homo sapiens
RAVGESCAGADSAASAAVGVVGPRAALTMTQQGAALQNYNNELVKCIEELCQKREELCRQIQVQVSSARGLSLWHPHSCPAREALVV

SEQ ID NO: 1033073 - protein, 110 aa, Homo sapiens
MTTGAAANYNDWSVHKDCANGDCGADQERRDKHGANEVRQLTEKLARVNENLARKIASRNEFDRTIAETEAAYLKILESSQTLLSVLKREAGNLTKATAPDQKSSGGRDS

SEQ ID NO: 1033074 - protein, 237 aa, Homo sapiens
RAVGESCAGADSAASAAVGVVGPRAALTMTQQGAALQNYNNELVKCIEELCQKREELCRQIQEEEDEKQRLQNEVRQLTEKLARVNENLARKIASRNEFDRTIAETEAAYLKNLKNSQFLNIKKKTKNLTKLQPQTKITTTTFFSNSFLLFLFFNPKFLKTSLFFTAAATFPHCLRCREGQVPASTGISDKPRAQPTRGSSLHAHTGYGDGGLQVSSARGLSLWHPHSCPAREALVV

SEQ ID NO: 1033075 - protein, 109 aa, Homo sapiens
RAVGESCAGADSAASAAVGVVGPRAALTMTQQGAALQNYNNELVKCIEELCQKREELCRQIQEEEDEKQRLQNEILESSQTLLSVLKREAGNLTKATAPDQKSSGGRDS

SEQ ID NO: 1033076 - protein, 83 aa, Homo sapiens; identical to SEQ ID NO: 1033066

SEQ ID NO: 1033077 - protein, 83 aa, Homo sapiens; identical to SEQ ID NO: 1033066

SEQ ID NO: 1033078 - protein, 554 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTANPIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTATALPRVGPVMPTGQDWNHTPQKTDHPSALLRDPPEPGSPRISSLRPQALSNPSTLSAQPQLSRSHSSGSVLPLGELEGRRSTRDRTSPAEPEAAPASEGAARPLPRFNSVPLTDTGHERQSEGSSSPQLQESVFHLLVPSVILVLLAVGGLLFYRWRRRSHQEPQRADSPLEQPEGSPLTQDDRQVELPV

SEQ ID NO: 1033079 - protein, 438 aa, Homo sapiens [sequence omitted]

SEQ ID NO: 1033080 - protein, 283 aa, Homo sapiens
LRVGQSCSIVDEALFFCVEQGMVDTGESETWGEMTPSLSQTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQGHERQSEGSSSPQLQESVFHLLVPSVILVLLAVGGLLFYRWRRRSHQEPQRADSPLEQPEGSPLTQDDRQVELPV

SEQ ID NO: 1033081 - protein, 617 aa, Homo sapiens
EGWPVRLGPGKVKVCLGPLGARAALRIPGQRCGPRPGRPLRSSQRASERARAADAPGRDPAARMTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSSSPQLQESVFHLLVPSVILVLLAVGGLLFYRWRRRSHQEPQRADSPLEQPEGSPLTQDDRQVELPV

SEQ ID NO: 1033082 - protein, 319 aa, Homo sapiens
EGWPVRLGPGKVKVCLGPLGARAALRIPGQRCGPRPGRPLRSSQRASERARAADAPGRDPAARMTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQGHERQSEGSSSPQLQESVFHLLVPSVILVLLAVGGLLFYRWRRRSHQEPQRADSPLEQPEGSPLTQDDRQVELPV

SEQ ID NO: 1033083 - protein, 617 aa, Homo sapiens; identical to SEQ ID NO: 1033081

SEQ ID NO: 1033084 - protein, 553 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSPRPQGLSNPSTLSAQPQLSRSHSSGSVLPLGELEGRRSTRDRRSPAEPEGGPASEGAARPLPRFNSVPLTDTHERQSEGSSSPQLQESVFHLLVPSVILVLLAVGGLLFYRWRRRSHQEPQRADSPLEQPEGSPLTQDDRQVELPV

SEQ ID NO: 1033085 - protein, 218 aa, Homo sapiens
YDHAFGAHGRRCKSMMLVVEAIVMLRMTSVGILTDMMGRKVGRTYVEKVPSIDVLAVITESIKKCASDLTSDIGDERPDLPEAPTNFRGPQARIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 1033086 - protein, 227 aa, Homo sapiens
MAVAFPSGCRRWRRCRSWCLMVEAISWAAWRSALRLAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKNMEDNRGLRPRILVEPLRCSPQQKHDM

SEQ ID NO: 1033087 - protein, 75 aa, Homo sapiens
EIIIIKFPAASNWLNEGGWKYQAVTATLEEKRKEKAKIHYRKKKQLMRLRKQAEKNVEKKIDKYTEVLKTHGLLV

SEQ ID NO: 1033088 - protein, 213 aa, Homo sapiens
FGTSGCRRWRRCRSWCLMVEAISWAAWRSALRLAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 1033089 - protein, 225 aa, Homo sapiens
RTYKVKKNPPGGYLYTERHTISLVQLVDRQRDGVQSVLMSASLALGIVLTVLWRECVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 1033090 - protein, 150 aa, Homo sapiens
MVSISCPRDLPTSASQSAGIIGVSHHAWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 1033091 - protein, 213 aa, Homo sapiens; identical to SEQ ID NO: 1033088

SEQ ID NO: 1033092 - protein, 224 aa, Homo sapiens
FGTSGCRRWRRCRSWCLMVEAISWAAWRSALRLAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKNMEDNRGLRPRILVEPLRCSPQQKHDM

SEQ ID NO: 1033093 - protein, 172 aa, Homo sapiens
FGTSGCRRWRRCRSWCLMVEAISWAAWRSALRLAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVEVPGSDSHPGGEEERESQDPLPEEETAHEATETGREERGEEN

SEQ ID NO: 1033094 - protein, 99 aa, Homo sapiens
FGTSGCRRWRRCRSWCLMVEAISWAAWRSALRLAKQVLLGRKVVVAPAVMGPRWRSVMSNIHHLSFESHGHEIQPCTVLENLASNSFPRVGDSRASRSN

SEQ ID NO: 1033095 - protein, 189 aa, Homo sapiens
RWRPALKQMGPPGLQKFGTRFVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 1033096 - protein, 213 aa, Homo sapiens; identical to SEQ ID NO: 1033088

SEQ ID NO: 1033097 - protein, 144 aa, Homo sapiens
MAVAFPSGCRRWRRCRSWCLMVEAISWAAWRSALRLAKQVLLGRKVVVVRCEGINISGNFYRNKLKYLAFLRKRMNTNPSRGPYHFRAPSRIFWRTARGIRCHKTKRGQAALDRLKVFDGIPPPYDMKYAAGSSRCPKLCPPPS

SEQ ID NO: 1033098 - protein, 216 aa, Homo sapiens
MAVAFPSGCRRWRRCRSWCLMVEAISWAAWRSALRLAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 1033099 - protein, 186 aa, Homo sapiens
GPEVVGASGRVVVHPLAVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 1033100 - protein, 213 aa, Homo sapiens; identical to SEQ ID NO: 1033088

SEQ ID NO: 1033101 - protein, 213 aa, Homo sapiens
FGTSGCRRWRRCRSWCLMVEAISWAAWRSALRLAKQVLLGRKVVVVRCEGINISGNFYRNKLKYLAFLRKRMNTNPSRGPYHFRAPSRIFWRTVRGMLPHKTKRGQAALDRLKVFDGIPPPYDKKKRMVVPAALKVVRLKPTRKFAYLGRLAPDGGWKYQAVTATLEEKRKEKAKIHYRKKKQLMRLRKQAEKNVEKKIDKYTEVLKTHGLLV

SEQ ID NO: 1033102 - protein, 215 aa, Homo sapiens
FGTSGCRRWRRCRSWCLMVEAISWAAWRSALRLAKQVLLGRKVVVVRCEGINISGNFYRNKLKYLAFLRKRMNTNPSRGPYHFRAPSRIFWLDLCEVMLAHKTKRGQAALDRLKVFDGIPPPYDKKKRMVVPAALKVVRLKPTRKFAYLGRLGSRRSGWKYQAVTATLEEKRKEKAKIHYRKKKQLMRLRKQAEKNVEKKIDKYTEVLKTHGLLV

SEQ ID NO: 1033103 - protein, 508 aa, Homo sapiens [sequence omitted]

SEQ ID NO: 1033104 - protein, 78 aa, Homo sapiens
VYSRVIPKQSYRLKFFPASADRTVIDYNGERTLDGFKKFLESGGQDGAGDDDDLEDLEEAEEPDMEEDDDQKAVKDEL

SEQ ID NO: 1033105 - protein, 481 aa, Homo sapiens
GDPGFIRRGRDRARALVAPAVPAAPTEAPRLIRVRHAAPRSAVPGRGRPGAAADAPEEEDHVLVLRKSNFAEAAGGATSTCWWSSMPLGVATARALAPEYAKAAGKLKAEGSEIRLAKVDATEESDLGQQYGVARLSHHQVLQELETRLPPRNIQLAREADDIVNWLKKRTGPAATTLRDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPDSEELTAERITEFCHRFLEGKIKPHLMSQERAGDWDKQPVKVLVGKNFEDVAFDEKKNVFVESMPHGVVTANSWLPFGINWGETYKDDDLEDLEEAEEPDMEEDDDQKAVKDEL

SEQ ID NO: 1033106 - protein, 546 aa, Homo sapiens
GDPGFIRRGRDRARALVAPAVPAAPTEAPRLIRVRHAAPRSAVPGRGRPGAAADAPEEEDHVLVLRKSNFAEAAGGATSTCWWSSMPLGVATARALAPEYAKAAGKLKAEGSEIRLAKVDATEESDLGQQYGVARLSHHQVLQELETRLPPRNIQLAREADDIVNWLKKRTGPAATTLRDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPDSEELTAERITEFCHRFLEGKIKPHLMSQERAGDWDKQPVKVLVGKNFEDVAFDEKKNVFVESMPHGVVTANSWLPFGINWGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 1033107 - protein, 546 aa, Homo sapiens; identical to SEQ ID NO: 1033106

SEQ ID NO: 1033108 - protein, 546 aa, Homo sapiens; identical to SEQ ID NO: 1033106

SEQ ID NO: 1033109 - protein, 168 aa, Homo sapiens
VEGGPRVGKGRRGEGDIGGDRGCPLLPVGGAVWLPGGVGTEDGTGFCVRVEVGAGHFWVNGDFRILSGCPPCLEEELVAASPGARHRPGPSPSLKPGLLLLSWAHCDHWPLYSTACGLFKAEPRPLTPGWGGGPRMLELNQTLTVLQAFLFHNRIEPHWPNKVEILPP

SEQ ID NO: 1033110 - protein, 118 aa, Homo sapiens
MGRGYENWQSLGAAGLKGFLTPALAMPSSLRKELSGEVVPPADQGRGHCAGSSLLGPQETTKCLGWWLPTALLLRPCPRPRCLGGWLPTAWVWLEWWQEWAPVRPRWPWGINQHAASC

SEQ ID NO: 1033111 - protein, 198 aa, Homo sapiens
NKLHSNYVGIRGNLGTKPLVRVPAQFLVAGAIAEYAPVIREPKFPRVAQFNIEDQQQFQGNLLENFPANLLTYIAFSLRIIHLCAPVQPPTTGTPKVAYTFDAGPQCRDLHPGRTLWLSLWLLCGTAFPQARNGDTFLKGLQVRPAPLSAELQAALAMEPTPGGVKYIIVTQVGPGPQILDDPCAHLLGPDGLPKPAA

SEQ ID NO: 1033112 - protein, 477 aa, Homo sapiens
MAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 1033113 - protein, 477 aa, Homo sapiens; identical to SEQ ID NO: 1033112

SEQ ID NO: 1033114 - protein, 591 aa, Homo sapiens
MWERLNCAAEDFYSRLLQKFNEEKKGIRKDPFLYEADVQVQLISKGQPNPLKNILNENDIVFIVEKVPLEKEETSHIEELQSEETAISDFSTGENVGPLALPVGKARQLIGLYTMAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 1033115 - protein, 477 aa, Homo sapiens; identical to SEQ ID NO: 1033112

SEQ ID NO: 1033116 - protein, 444 aa, Homo sapiens
CEGLQFCSSDNVILSCAFTFLSFISYADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 1033117 - protein, 477 aa, Homo sapiens; identical to SEQ ID NO: 1033112

SEQ ID NO: 1033118 - protein, 331 aa, Homo sapiens
MWERLNCAAEDFYSRLLQKFNEEKKGIRKDPFLYEADVQVQLISKGQPNPLKNILNENDIVFIVEKVPLEKEETSHIEELQSEETAISDFSTGENVGPLALPVGKARQLIGLYTMAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSNSDICEYLKVGIKGGAQRVLGTHLLNEETGHIFPGYGEQGFTHVGVPSECVRLRVMPTVACNSVRKRKGRKTGRMRGLQHNTVNIT

SEQ ID NO: 1033119 - protein, 554 aa, Homo sapiens
MWERLNCAAEDFYSRLLQKFNEEKKGIRKDPFLYEADVQVQLISKGQPNPLKNILNENDIVFIVEKVPLEKEETSHIEELQSEETAISDFSTGENVGPLALPVGKARQLIGLYTMAHNPNMTHLKINLPVTALPPLADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 1033120 - protein, 217 aa, Homo sapiens
MAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSNSDICEYLKVGIKGEAQRVLGTHLLNEETGHIFPGYGEQGFTHVGVPSECVRLRVMPTVACNSVRKRKGRKTGRMRGLQHNTVNIT

SEQ ID NO: 1033121 - protein, 375 aa, Homo sapiens
MFLRSRVGRPINNEKIDILMIDMDGTQSKSKVRCERHSVGVLPCRLHCWLPLTKGVPLYRQIADLAGYSEVILRDVPSGVQMSNNWRVLNVLANRDAVAIALSSMIRPKIWMHDNTFSGSQCSNKEQRFTTTLKNVIKEKYGKDATNVGDEGGFAPNILENKEGLELLKTAIGKAGYTDKVVIGMDVAAPSSSGLGSMTWTSSLPMTPAGTSRLTSWLTCTSPSSRTTQWCLSKIPLTRMTGELGRKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1033122 - protein, 461 aa, Homo sapiens
MFLRSRVGRPINNEKIDILMIDMDGTQSKSKVRCERHSVGVLPCRLHCWLPLTKGVPLYRQIADLAGYSEVILRDVPSGVQMSNNWRVLNVLANRDAVAIALSSMIRPKIWMHDNTFSGSQCSNKEQRFTTTLKNVIKEKYGKDATNVGDEGGFAPNILENKEGLELLKTAIGKAGYTDKVVIGMDVAAPSSSGLGSMTWTSSLPMTPAGTSRLTSWLTCTSPSSRTTQWCLSKIPLTRMTGELGRKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELEHATGPKYCPSKDSLQEDPPLGQRYRMCGKANATFVYDLVGLSHDRSSLSVSVSVQADGPRTQQLCKGVPVVVERPQLRVWSSYRFLRNFYMKPSSLEPRWQL

SEQ ID NO: 1033123 - protein, 254 aa, Homo sapiens
MRIGAEVYRQLCKNVIKEKYGKDATNVGDEGGFAPNILENKEGLELLKTAIGKAGYTDKVVIGMDVAAPSSSGLGSMTWTSSLPMTPAGTSRLTSWLTCTSPSSRTTQWCLSKIPLTRMTGELGRKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1033124 - protein, 375 aa, Homo sapiens; identical to SEQ ID NO: 1033121

SEQ ID NO: 1033125 - protein, 397 aa, Homo sapiens
MFLRSRVGRPINNEKIDILMIDMDGTQSKSKVRCERHSVGVLPCRLHCWLPLTKGVPLYRQIADLAGYSEVILRDVPSGVQMSNNWRVLNVLANRDAVAIALSSMIRPKIWMHDNTFSGSQCSNKEQRFTTTLKNVIKEKYGKDATNVGDEGGFAPNILENKEGLELLKTAIGKAGYTDKVVIGMDVAAPSSSGLGSMTWTSSLPMTPAGTSRLTSWLTCTSPSSRTTQWCLSKIPLTRMTGELGRKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGYLEANAWPVRILQRLPSGSRYAVVQCPRPFGSPVGLLR

SEQ ID NO: 1033126 - protein, 385 aa, Homo sapiens
MFLRSRVGRPINNEKIDILMIDMDGTQSKSKVRCERHSVGVLPCRLHCWLPLTKGVPLYRQIADLAGYSEVILPVPAFICPQWLVLMLVNKLDHARQLHDSSQDRVQKYFTGKPMRHWETEGFSRTNLEECRLTEEIIWEEMHTQSVGDRNGGVGSPDIRWEEYSIGLSEWKSQWYVEKVGLICDYRVVASDIEDVTGSREFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 1033127 - protein, 493 aa, Homo sapiens [sequence omitted]

SEQ ID NO: 1033128 - protein, 539 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFWYRVSVSAEQPWAHAPSSKAPLLLLHVRAALEEAGSLSQQNSCAPSGFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033129 - protein, 421 aa, Homo sapiens
MLTAISCILPMALVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033130 - protein, 519 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVAVDAHCHQLHPPYGTGITRSGIAGSQSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033131 - protein, 528 aa, Homo sapiens
NKARYEAWVVTQAEASGGSSAGLTGVGPPPPLPLRPNPVPLARPDPVWLVRAQRPRGRSSRWKSYYVEYLGDICLRDLQELQIESRSVAQAGVQWCNLCSLQPPSPEFKQFSCLSLLSSWESHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033132 - protein, 94 aa, Homo sapiens
QIRLGSEAWVVTQAEASGGSSAGLTGVGPPPPLPLRPNPVPLARPDPVWLVRAQRPRGRSSRWKSYYVEYLGDICLRDLQELQKTKILMHLRKR

SEQ ID NO: 1033133 - protein, 136 aa, Homo sapiens
NKARYEAWVVTQAEASGGSSAGLTGVGPPPPLPLRPNPVPLARPDPVWLVRAQRPRGRSSRWKSYYVEYLGDICLRDLQELQIESRSVAQAGVQWCNLCSLQPPSPEFKQFSCLSLLSSWDYRCMPSCLANFRIST

SEQ ID NO: 1033134 - protein, 125 aa, Homo sapiens
PWLAAGGASPRASLAGPGLRLRRRPGGPGAPRRRHVVRALPAVSGRAPSVCLPFFLPPPSQLSERSEATASDQPAPAHLGPLSLSGAAGKRAASGLTTRVIFGSSRSAARAVYTPACGGYPQLAG

SEQ ID NO: 1033135 - protein, 71 aa, Homo sapiens
MYHAPTDCATIRKWLTKCADDSETANYISAHTKDVKDRILPLMDLPSLVLPRAPWRFAISEQNTQSPTLPE

SEQ ID NO: 1033136 - protein, 589 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFWYRVSVSAEQPWAHAPSSKAPLLLLHVRAALEEAGSLSQQNSCAPSGFKCRQMYHAPTDCATIRKWLTKCADDSETANYISAHTKDPQRPATFKEVLLPRSAHTMSNWAQVPGALCNLFKTNLVVCEPNGTLLSPPCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033137 - protein, 493 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033138 - protein, 503 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVITRSGIAGSQSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033139 - protein, 488 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGVSAYCPLGFYIAGRGLAW

SEQ ID NO: 1033140 - protein, 351 aa, Homo sapiens
MQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033141 - protein, 160 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVETDSRCVTQAGVQWHDLGSLQAPPTGFIPFSCLSLPSSWDYRCPPTLPAKFLLYLNVETGFHLVSQDGLDLLTS

SEQ ID NO: 1033142 - protein, 160 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVETDSRCVTQAGVQWHDLGSLQAPPTGFIPFSCLSLPSSWDYRCPPTLPAKFFLYLNVETGFHLVSQDGLDLLTS

SEQ ID NO: 1033143 - protein, 493 aa, Homo sapiens [sequence omitted]

SEQ ID NO: 1033144 - protein, 493 aa, Homo sapiens [sequence omitted]

SEQ ID NO: 1033145 - protein, 102 aa, Homo sapiens
MYHAPTDCATIRKWLTKCADDSETANYISAHTKDCPKCNICIEKNGGCNHMQCSKCKHGEFQAWCVRPSGTFLWLGLRYYLSEYFCHEMTKHEKNLSHLTVT

SEQ ID NO: 1033146 - protein, 493 aa, Homo sapiens [sequence omitted]

SEQ ID NO: 1033147 - protein, 493 aa, Homo sapiens; identical to SEQ ID NO: 1033137

SEQ ID NO: 1033148 - protein, 522 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDPQRPATFKGGAPPQKCSHHEQLGTGARSFVYICLKTNLVVCEPNGTLLSPPCPKCNICIEKNGGCNHMQCSKCKHDFCWMCLGDWKTHGSEYYECSRYKENPDIVNQSQQAQAREALKKYLFYFERWERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033149 - protein, 486 aa, Homo sapiens
MGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 1033150 - protein, 104 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVRRTPAWATQRDSVSKKKT

SEQ ID NO: 1033151 - protein, 119 aa, Homo sapiens
MMLISRLWVVVMTPIMCFLESMPLIYINIILAFTISLLGILVYRSHLISSLLCLEGIILSLFIIATLITLNTHSLLANIVPIAILVFAACEAAVGLALLVSISNTYGLDYVHNLNLLQC

SEQ ID NO: 1033152 - protein, 119 aa, Homo sapiens; identical to SEQ ID NO: 1033151

SEQ ID NO: 1033153 - protein, 119 aa, Homo sapiens; identical to SEQ ID NO: 1033151

SEQ ID NO: 1033154 - protein, 119 aa, Homo sapiens; identical to SEQ ID NO: 1033151

SEQ ID NO: 1033155 - protein, 119 aa, Homo sapiens; identical to SEQ ID NO: 1033151

SEQ ID NO: 1033156 - protein, 119 aa, Homo sapiens; identical to SEQ ID NO: 1033151

SEQ ID NO: 1033157 - protein, 119 aa, Homo sapiens; identical to SEQ ID NO: 1033151

SEQ ID NO: 1033158 - protein, 119 aa, Homo sapiens; identical to SEQ ID NO: 1033151

SEQ ID NO: 1033159 - protein, 119 aa, Homo sapiens; identical to SEQ ID NO: 1033151

SEQ ID NO: 1033160 - protein, 119 aa, Homo sapiens; identical to SEQ ID NO: 1033151

SEQ ID NO: 1033161 - protein, 119 aa, Homo sapiens; identical to SEQ ID NO: 1033151

SEQ ID NO: 1033162 - protein, 108 aa, Homo sapiens
MCLSGVENECEAYYNKLHLPTTNRPKIAHCILFNQPHSPRSNSHSHPNPLKLHRRSHSHNRPRTYILITILPSKLKLRTHSQSHHNPLSRTSNSTPTNSFLMTSSKPR

SEQ ID NO: 1033163 - protein, 119 aa, Homo sapiens; identical to SEQ ID NO: 1033151

SEQ ID NO: 1033164 - protein, 119 aa, Homo sapiens; identical to SEQ ID NO: 1033151

SEQ ID NO: 1033165 - protein, 119 aa, Homo sapiens; identical to SEQ ID NO: 1033151

SEQ ID NO: 1033166 - protein, 119 aa, Homo sapiens; identical to SEQ ID NO: 1033151

SEQ ID NO: 1033167 - protein, 335 aa, Homo sapiens
LRALSAKAACSVTAQPAAVSRITSWVVLHGHEPLIGLPVDWGTSCVLHGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPFGAGHPERALPPLTPFFPDKPITQYPHAAVEVTPLLIAGLRPWNQCPGHLQRAPSEYFQRTPSSTQQCRRRRRVQRYSRTGYYEL

SEQ ID NO: 1033168 - protein, 306 aa, Homo sapiens
LRALSAKAACSVTAQPAAVSRITSWVVLHGHEPLIGLPVDWGTSCVLHGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEGDPLRELGSECGIEFDEEKTAVIDHHNYDISDLGQHTLIVADTENLLKAPTIVGKSSLNPILFRGVGMVADPDNPFGAGHPERALPPLTPFFPDKPITQYPHAAVEVTPLLIAGLRPWNQCPGHLQRAPSEYFQRTPSSTQQCRRRRRVQRYSRTGYYEL

SEQ ID NO: 1033169 - protein, 349 aa, Homo sapiens
MHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCCPGQTAWSWSGVRAPQRRSVGPGPDVTAGGPVEARQHPYALQCPGWSHPHPVQGGGLPAAGGQPAGPALGSAMPPGGGEPGVAPGAADRRGGRGQVQERQREREGADEGHHRDLPDAAALSQGHTAAVCGQLLPERRGACDAVPPAVKYFFDFLDEQAEKHNIQDEDTIHIWKTNTLPLRFWVNILKNPHFIFDVHVTRWWTPRCQSSPGI

SEQ ID NO: 1033170 - protein, 349 aa, Homo sapiens
WIWRTWSQNSNRSIATLASPPSRTRGLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDRTCTHTWKISLGAPDSLNTLALHHLYQYTFYIIALEEDPAAQKMQLAFRLQQNAAALENKTDLLYNLQCLGTEVPEVLRALRGGGRVAVAEAPPPWNAPKPEWVQRNPPSV

SEQ ID NO: 1033171 - protein, 349 aa, Homo sapiens; identical to SEQ ID NO: 1033169

SEQ ID NO: 1033172 - protein, 349 aa, Homo sapiens; identical to SEQ ID NO: 1033169

SEQ ID NO: 1033173 - protein, 973 aa, Homo sapiens
MIVRATVVAGGSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDEVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVWGIHYGPFFKRFDRSFLFHSRLLTITSFSVPRLPSFRCPRFIIIHPRNLKGKNWGAVAQACNPRTLGGRGGRIM

SEQ ID NO: 1033174 - protein, 203 aa, Homo sapiens
MSGQRVDVKVVMLGKEYVGKTSLVERYVHDRFLVGPYQNTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADNIKAQLFETSSKTGQSVDELFQKVAEDYVSVAAFQVMTEDKGVDLGQKPNPYFYSCCHH

SEQ ID NO: 1033175 - protein, 184 aa, Homo sapiens
MSGQRVDVKVVMLGKEYVGKTSLVERYVHDRFLVGPYQNTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADSSCSSALWGVGVCGCLGGSKKIGTALAARARCSRRSSWPP

SEQ ID NO: 1033176 - protein, 224 aa, Homo sapiens
MSGQRVDVKVVMLGKEYVGKTSLVERYVHDRFLVGPYQNTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADNIKAQLFETSSKTGQSVDELFQKVAEDYVSVAAFQVMTEDKGVDLGQKPRFTHRPRFTHRPRFTHQPRFTHQPEDSSLQQ

SEQ ID NO: 1033177 - protein, 133 aa, Homo sapiens
MQGHQRKLNRAQRAGSLGDPRATGIGPSLIIIFPARRALPESGRGLRQCGCLPGDDRGQGRGSGPEAKPLLLQLLSSLSQHSPGLGELKEFPVRAGPSSFLGLGSQMSELPQVLMSAEWRLPVLAHGTETALG

SEQ ID NO: 1033178 - protein, 203 aa, Homo sapiens; identical to SEQ ID NO: 1033174

SEQ ID NO: 1033179 - protein, 203 aa, Homo sapiens; identical to SEQ ID NO: 1033174

SEQ ID NO: 1033180 - protein, 184 aa, Homo sapiens; identical to SEQ ID NO: 1033175

SEQ ID NO: 1033181 - protein, 174 aa, Homo sapiens
MAPISSLSLQTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADNIKAQLFETSSKTGQSVDELFQKVAEDYVSVAAFQVMTEDKGVDLGQKPNPYFYSCCHH

SEQ ID NO: 1033182 - protein, 189 aa, Homo sapiens [sequence omitted]

SEQ ID NO: 1033183 - protein, 88 aa, Homo sapiens
MSGQRVDVKVVMLGKEYVGKTSLVERYVHDRFLVGPYQNTIGAAFVAKVMSVGDRTVTLGIWDTAGSERYEAMSRIYYRGRVAGTELD

SEQ ID NO: 1033184 - protein, 155 aa, Homo sapiens
MAPISSLSLQTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADSSCSSALWGVGVCGCLGGSKKIGTALAARARCSRRSSWPP

SEQ ID NO: 1033185 - protein, 172 aa, Homo sapiens
MSGQRVDVKVVMLGKEYVGKTSLVERYVHDRFLVGPYQNTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADSSCSSALWGVGVFSFLVFFSSLFAFYIW

SEQ ID NO: 1033186 - protein, 184 aa, Homo sapiens; identical to SEQ ID NO: 1033175

SEQ ID NO: 1033187 - protein, 174 aa, Homo sapiens; identical to SEQ ID NO: 1033181

SEQ ID NO: 1033188 - protein, 172 aa, Homo sapiens; identical to SEQ ID NO: 1033185

SEQ ID NO: 1033189 - protein, 116 aa, Homo sapiens
MRYPAGRWIPRPAARPPFPAFALPYAAAPAGFSARGLRTLLPELGPPLTAAAGAAARRSAGAPDAEAGLAPGELQQLAQGPEDLLLLSDELRQPIWGACRGCRAGGQCFHLPGSQA

SEQ ID NO: 1033190 - protein, 116 aa, Homo sapiens; identical to SEQ ID NO: 1033189

SEQ ID NO: 1033191 - protein, 97 aa, Homo sapiens
MCGPSSCFKPAAATGGATPVAVTIAGREAGSSLLLQVPGGRQGDCPLVCQPHRFTGEDIRQPGQSQIGGCTCRIPLDISVFRLFPSERRERPASPKR

SEQ ID NO: 1033192 - protein, 181 aa, Homo sapiens
YSLCHVGGRGEKCKNAGLAKSIGVSNFTRSQLEMILDNQVSSTSLSATRWNVILLQPEKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 1033193 - protein, 924 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 1033194 - protein, 943 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 1033195 - protein, 943 aa, Homo sapiens; identical to SEQ ID NO: 1033194

SEQ ID NO: 1033196 - protein, 943 aa, Homo sapiens; identical to SEQ ID NO: 1033194

SEQ ID NO: 1033197 - protein, 943 aa, Homo sapiens; identical to SEQ ID NO: 1033194

SEQ ID NO: 1033198 - protein, 171 aa, Homo sapiens
MGVLEILDVFGAAELRQACRPHQGKEVEEEKPVAPQDGVGPFTVAPEPFKFLTIISLPLLNHMDKVVGEDEWDTLAVDSKLGLEIPQKVAKINVEQLPTLSDHDVVAVPIANAQHICGHTIASTGEGELLNGSIQGLPRVLGLQPVEQGILVEGGCGCHVALVELDVGDGV

SEQ ID NO: 1033199 - protein, 908 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMEVGVGGRPPGLRGSTGQGLREAGTARLLQTY

SEQ ID NO: 1033200 - protein, 656 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIIWFSAYLVPS

SEQ ID NO: 1033201 - protein, 729 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCIKRTRDHKNAMIEAMPHPKRGEHKQNGTRRGPRITYPPQTRKTGRSEHTQTDTNKQGETRPITQHDHRRPLTPGNDNAGERKHLAGTKTRPTTDSKRHDPQGTPTYTRTINKKQTTTHHTRQQTDTHNSRPS

SEQ ID NO: 1033202 - protein, 525 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQGTCHYPPPSTRELSCTSLLGWWQQAVIGILQPYPRVLDLFLPFPVYSLFGDTAVTPL

SEQ ID NO: 1033203 - protein, 825 aa, Homo sapiens
MDKVVGEDEWDTLAVDSKLGLEIPQKVAKINVEQLPTLSDHDVVAVPIANAQHICGHTIASTGEGELLNGSIQGLPRVLGLQPVEQGILVEGGCGCHVALVELDVGDGVCTEYHLNEACAVPGGEAAIGGHPQVQPLLLPQDVHELDHLQGQHVLPEVIPVLKDDAHAAAAACLLVAVHDPQGLHLGVHEGALLHADFSQQGAGVEWGLQVGEGLKVGLLPHAQVHQLLGLGLGGLLRAQLDEVIQGLQFAQCFPLLHQHLHVVGAAPAVGLQDEAEAQGHRRHVHLGAEVPEKEVADLAVGQGPVQQEFGQLAVQVGLVLEHLHQLQQVLEQLIVRQFPQRLDGEGAYVAIGEAEVKQLQGAQDGQLRPGAQQVEHLGHILMLVPLGDQQQPGYRLREVLLDFMPQLPHQVLLVLIQLPRPPPLQDFPQLQLLLLGDMHTLAVSPQLQDLLQGGVVHGVRGHLGQADEQGSGAIRVGVTAHSARGVQQLALLIWDGGPHVEAAFPGLKLVLVVKQHEVGPGNGAVRLLGLLLGGASLLGFLDHGVQRKAETGHAGQVADVDVELQPLLPHGLRAHAHLRAGHRLAQHLVAVEKPGLHHQLHPLVGVHFAALDELDAERLLQGPQGHRGRLLRRNGRWFGTRFLDLGGRVALLIPHGEDGGGMDHGQVRGQPTVQAAADVLELAERVAAIQVLMPAVHLQRVVFRLLHQRLPEHCGLLPQGTGHQRQRHVLGGHLEGEALLAALKLNVDQKGPVREPQGTRPPGLSRGLQLQGETVLQPGLPAQLLPAGGRLLAELAHLGAKVVHFWVAQGVKLVEAFADEEADL

SEQ ID NO: 1033204 - protein, 213 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVQVFEFQLTSEEMKAIDGLNRNVRYLTLDIFAGPPNYPFSDEY

SEQ ID NO: 1033205 - protein, 120 aa, Homo sapiens
MPLGEGGLRMTEEFHRGSAPHGQSSLDAAGHAWAHLAALKLNVDQKGPVREPQGTRPPGLSRGLQLQGETVLQPGLPAQLLPAGGRLLAELAHLGAKVVHFWVAQGVKLVEAFADEEADL

SEQ ID NO: 1033206 - protein, 181 aa, Homo sapiens; identical to SEQ ID NO: 1033192

SEQ ID NO: 1033207 - protein, 181 aa, Homo sapiens
YSLCHVGGRGEKCKNAGLAKSIGVSNFTRSQLEMILDNQVSSTSLSATRWNVILLQPEKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRSFTVECFRPPSKYGVLTEY

SEQ ID NO: 1033208 - protein, 943 aa, Homo sapiens; identical to SEQ ID NO: 1033194

SEQ ID NO: 1033209 - protein, 943 aa, Homo sapiens; identical to SEQ ID NO: 1033194

SEQ ID NO: 1033210 - protein, 1206 aa, Homo sapiens
MHHCTPAWATEEDPISKKKKKIFEIMAEYVASDLLLPSCVTGVSYMEAQISLTRPEDQRRFSFMGLGLISPAVEVWWVIYYFLTCKQNHFTVEKDEGILVPKTHLKKWRASIPESRGYPGCLGELPELSLGRYTGGSHEDRGILSDSRHQVTARRQDPGSLAGGLGRRFPREENSLCWAQIHQLEDLEVTILSREPGAASGGPAPPLHEGGVFRLWLFSSLNYFKSSNKYTSVNKRQPCRFFPVRCSSGSSAPLGPMCLVPTTRSRLLLGPGLGGATTACCLWTRCGPPVHFGFPALTEGFVKLHSEVLQCLLLCFPQCQGVLEILDVFGAAELRQACRPHQGKEVEEEKPVAPQDGVGPFTVAPEPFKFLTIISLPLLNHMDKVVGEDEWDTLAVDSKLGLEIPQKVAKINVEQLPTLSDHDVVAVPIANAQHICGHTIASTGEGELLNGSIQGLPRVLGLQPVEQGILVEGGCGCHVALVELDVGDGVCTEYHLNEACAVPGGEAAIGGHPQVQPLLLPQDVHELDHLQGQHVLPEVIPVLKDDAHAAAAACLLVAVHDPQGLHLGVHEGALLHADFSQQGAGVEWGLQVGEGLYVGLLPHAQVHQLLGLGLGGLLRAQLDEVIQGLQFAQCFPLLHQHLHVVGAAPAVGLQDEAEAQGHRRHVHLGAEVPEKEVADLAVGQGPVQQEFGQLAVQVGLVLEHLHQLQQVLEQLIVRQFPQRLDGEGAYVAIGEAEVKQLQGAQDGQLRPGAQQVEHLGHILMLVPLGDQQQPGERLREVLLDFMPQLPHQVLLVLIQLPRPPPLQDFPQLQLLLLGDMHTLAVSPQLQDLLQGGVVHGVRGHLGQADEQGSGAIRVGVTAHSARGVQQLALLIWDGGPHVEAAFPGLKLVLVVKQHEVGPGNGAVRLLGLLLGGASLLGFLDHGVQRKAETGHAGQVADVDVELQPLLPHGLRAHAHLRAGHRLAQHLVAVEKPGLHHQLHPLVGVHFAALDELDAERLLQGPQGHRGRLLRRNGRWFGTRFLDLGGRVALLIPHGEDGGGMDHGQVRGQPTVQAAADVLELAERVAAIQVLMPAVHLQRVVFRLLHQRLPEHCGLLPQGTGHQRQRHVLGGHLEGEALLAALKLNVDQKGPVREPQGTRPPGLSRGLQLQGETVLQPGLPAQLLPAGGRLLAELAHLGAKVVHFWVAQGVKLVEAFADEEADL

SEQ ID NO: 1033211 - protein, 1100 aa, Homo sapiens
MWRASIPESRGYPGCLGELPELSLGRYTGGSHEDRGILSDSRHQVTARRQDPGSLAGGLGRRFPREENSLCWAQIHQLEDLEVTILSREPGAASGGPAPPLHEGGVFRLWLFSSLNYFKVINKYTSVNKRQPCRFFPVRCSSGSSAPLGPMCLVPTTRSRLLLAQGWEEPLLPVVFGHVVGQPVHFGFPALTEGFVKLHSEVLQCLLLCFPQCQGVLEILDVFGAAELRQACRPHQGKEVEEEKPVAPQDGVGPFTVAPEPFKFLTIISLPLLNHMDKVVGEDEWDTLAVDSKLGLEIPQKVAKINVEQLPTLSDHDVVAVPIANAQHICGHTIASTGEGELLNGSIQGLPRVLGLQPVEQGILVEGGCGCHVALVELDVGDGVCTEYHLNEACAVPGGEAAIGGHPQVQPLLLPQDVHELDHLQGQHVLPEVIPVLKDDAHAAAAACLLVAVHDPQGLHLGVHEGALLHADFSQQGAGVEWGLQVGEGLKVGLLPHAQVHQLLGLGLGGLLRAQLDEVIQGLQFAQCFPLLHQHLHVVGAAPAVGLQDEAEAQGHRRHVHLGAEVPEKEVADLAVGQGPVQQEFGQLAVQVGLVLEHLHQLQQVLEQLIVRQFPQRLDGEGAYVAIGEAEVKQLQGAQDGQLRPGAQQVEHLGHILMLVPLGDQQQPGERLREVLLDFMPQLPHQVLLVLIQLPRPPPLQDFPQLQLLLLGDMHTLAVSPQLQDLLQGGVVHGVRGHLGQADEQGSGAIRVGVTAHSARGVQQLALLIWDGGPHVEAAFPGLKLVLVVKQHEVGPGNGAVRLLGLLLGGASLLGFLDHGVQRKAETGHAGQVADVDVELQPLLPHGLRAHAHLRAGHRLAQHLVAVEKPGLHHQLHPLVGVHFAALDELDAERLLQGPQGHRGRLLRRNGRWFGTRFLDLGGRVALLIPHGEDGGGMDHGQVRGQPTVQAAADVLELAERVAAIQVLMPAVHLQRVVFRLLHQRLPEHCGLLPQGTGHQRQRHVLGGHLEGEALLAALKLNVDQKGPVREPQGTRPPGLSRGLQLQGETVLQPGLPAQLLPAGGRLLAELAHLGAKVVHFWVAQGVKLVEAFADEEADL

SEQ ID NO: 1033212 - protein, 711 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGSV

SEQ ID NO: 1033213 - protein, 637 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIIWFSAYLVPS

SEQ ID NO: 1033214 - protein, 586 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRCVYS

SEQ ID NO: 1033215 - protein, 325 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGKETRRSCIRLALVKVGGTFTTGNTCVCCVHNYKL

SEQ ID NO: 1033216 - protein, 241 aa, Homo sapiens
ARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGELHSLPCAHICS

SEQ ID NO: 1033217 - protein, 213 aa, Homo sapiens; identical to SEQ ID NO: 1033204

SEQ ID NO: 1033218 - protein, 206 aa, Homo sapiens
MATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDHISRYCWDPQSYYAGTGSRSIFFKSHKR

SEQ ID NO: 1033219 - protein, 206 aa, Homo sapiens; identical to SEQ ID NO: 1033218

SEQ ID NO: 1033220 - protein, 206 aa, Homo sapiens; identical to SEQ ID NO: 1033218

SEQ ID NO: 1033221 - protein, 206 aa, Homo sapiens; identical to SEQ ID NO: 1033218

SEQ ID NO: 1033222 - protein, 229 aa, Homo sapiens
MLAQAQEVFFLKATRDKMKDAIIAKLANQAADYFGDAFKQCQYKDTLPKEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLINRSIAQMREATTWANGVLASLNLPAAIEDVSGDTVPQVYID

SEQ ID NO: 1033223 - protein, 489 aa, Homo sapiens
GQRLLRRGTGGWRWWLLVCWGSVVAAAERAWGWWRGHWTGCAWLLPDRREAAEAEAEVPVVQYVWRARCPADRVFVWGFIFSRWLLGSAFLCGAQLSRTPGCPVAGSSRRRPVSDPDPCLYRLELDQKISSAVLQCMDSHLLSSKTADVKKVLGVMGLNKDSQLVIYTGAVKDNTRGSEYVLEPVQPSLLPLDMTWGDPRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRVTMPGEPVDVACGVDHMVTLAKSFI

SEQ ID NO: 1033224 - protein, 431 aa, Homo sapiens
GQRLLRRGTGGWRWWLLVCWGSVVAAAERAWGWWRGHWTGCAWLLPDRREAAEAEAEVPVVQYVWRARCPADRVFVWGFIFSRWLLGSAFLCGAQLSRTPGCPVAGSSRRRPVSDPDPCLYRLELDQKISSAVLQCMDSHLLSSKTADVKKVLGVMGLNKDSQLVIYTGAVKDNTRGSEYVLEPVQPSLLPLDMTWGDPRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNDKGELFVWGKNIRGCLGIGRLEDQYFPWRVTMPGEPVDVACGVDHMVTLAKSFI

SEQ ID NO: 1033225 - protein, 222 aa, Homo sapiens
MQSAPFLDAGLAMALGTPGVVEDVRFHGEAIEQWAPFQQAEPPCLSEGHLLAPLKLGLSSDAMLSAQTGSVIRAPGRGSFETQPLPLLGGRDLGRRLPVTGAGGEGDDAWGACGRGMWRGPHGDPGQVIHLNLPHLLGRPRPGNHWHSLAEASAWPAPRGSWMVVAEDPACSVTLCPESLSGYLPGGSGQGPSPAAGEACGTQLGWQPLVGRCGPHVSVLSK

SEQ ID NO: 1033226 - protein, 144 aa, Homo sapiens
SYVAQAGLELLPQVVFPPWPHKMLELLGDDAWGACGRGMWRGPHGDPGQVIHLNLPHLLGRPRPGNHWHSLAEASAWPAPRGSWMVVAEDPACSVTLCPESLSGYLPGGSGQGPSPAAGEACGTQLGWQPLVGRCGPHVSVLSK

SEQ ID NO: 1033227 - protein, 489 aa, Homo sapiens; identical to SEQ ID NO: 1033223

SEQ ID NO: 1033228 - protein, 489 aa, Homo sapiens; identical to SEQ ID NO: 1033223

SEQ ID NO: 1033229 - protein, 489 aa, Homo sapiens; identical to SEQ ID NO: 1033223

SEQ ID NO: 1033230 - protein, 489 aa, Homo sapiens; identical to SEQ ID NO: 1033223

SEQ ID NO: 1033231 - protein, 481 aa, Homo sapiens
GQRLLRRGTGGWRWWLLVCWGSVVAAAERAWGWWRGHWTGCAWLLPDRREAAEAEAEVPVVQYVWRARCPADRVFVWGFIFSRWLLGSAFLCGAQLSRTPGCPVAGSSRRRPVSDPDPCLYRLELDQKISSAVLQCMDSHLLSSKTADVKKVLGVMGLNKDSQLVIYTGAVKDNTRGSEYVLEPVQPSLLPLDMTWGDPRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRVRLAGEVMRLDAKSRVT

SEQ ID NO: 1033232 - protein, 192 aa, Homo sapiens
NSLRCFSVGRALARFIQLAELFGCLIQPRNPGFPHPMWTQPLCCTDQQRRAVCMGQEHPRVPGNRSPGGPVFPMEGDDAWGACGRGMWRGPHGDPGQVIHLNLPHLLGRPRPGNHWHSLAEASAWPAPRGSWMVVAEDPACSVTLCPESLSGYLPGGSGQGPSPAAGEACGTQLGWQPLVGRCGPHVSVLSK

SEQ ID NO: 1033233 - protein, 403 aa, Homo sapiens
GQRLLRRGTGGWRWWLLVCWGSVVAAAERAWGWWRGHWTGCAWLLPDRREAAEAEAEVPVVQYVWRARCPADRVFVWGFIFSRWLLGSAFLCGAQLSRTPGCPVAGSSRRRPVSDPDPCLYRLELDQKISSAVLQCMDSHLLSSKTADVKKVLGVMGLNKDSQLVIYTGAVKDNTRGSEYVLEPVQPSLLPLDMTWGDPRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGVTMPGEPVDVACGVDHMVTLAKSFI

SEQ ID NO: 1033234 - protein, 489 aa, Homo sapiens; identical to SEQ ID NO: 1033223

SEQ ID NO: 1033235 - protein, 489 aa, Homo sapiens; identical to SEQ ID NO: 1033223

SEQ ID NO: 1033236 - protein, 489 aa, Homo sapiens; identical to SEQ ID NO: 1033223

SEQ ID NO: 1033237 - protein, 389 aa, Homo sapiens
GQRLLRRGTGGWRWWLLVCWGSVVAAAERAWGWWRGHWTGCAWLLPDRREAAEAEAEVPVVQYVWRARCPADRVFVWGFIFSRWLLGSAFLCGAQLSRTPGCPVAGSSRRRPVSDPDPCLYRLELDQKISSAVLQCMDSHLLSSKTADVKKVLGVMGLNKDSQLVIYTGAVKDNTRGSEYVLEPVQPSLLPLDMTWGDPRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSLLMALPGRLPHRKLAGGTLEAPWPGIPSGAVRRHQPQPPTTLTAWLGKVKKPLRKRIEAKFLCAEGPEHIRQGSAAVPGGGGRSRNCEQCLI

SEQ ID NO: 1033238 - protein, 104 aa, Homo sapiens
CPALAWLLVSLNQDTLEQSPESCLIRGGLGRWSLRLLPPEDTNHDSRLLKPEQVSVGRPEGGFEVVPGTGVTEWTAQGAALPGLVKPQMSPIQGSGGAAVTPEA

SEQ ID NO: 1033239 - protein, 190 aa, Homo sapiens
PRTWLPVQLQAEGRAWDLGLKRPSDFQDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVSTCPRPAWSRPPGHRHGWAVGLRLAPLLVVAVTWVREGRACRNQVGAGILRV

SEQ ID NO: 1033240 - protein, 631 aa, Homo sapiens
MAQQHARHGDAADYEFSSSFALPAFSVDSIFYITPWTDHWKALAFRLEEEQKMRPEIAGLKPANPPVLPAPQKADSDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 1033241 - protein, 873 aa, Homo sapiens
MAQQHARHGDAADYEFSSSFALPAFSVDSIFYITPWTDHWKALAFRLEEEQKMRPEIAGLKPANPPVLPAPQKADSDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVSTCPRPAWSRPPGHRHGWAVGLRLAPLLVVAVTWVREGRACRSLGVATLQLGGPGIPIPTELHGCGTQSTWRGWAPLIFISQGLSREGLCCGPSIPPVEEAHAPMTGAPSPLWTRPCFRSRPPRQSVTSWLCCDLGLRPPLPPLPPSALCPVPCAATVRPPEPRFWGRRFLSWSLEGCWHFQVGSGGTTRLRLGVAIIQAPSTLSLRWGPHSLWGGERFGDEAEGGAGCPPCGDEALAAAQVPSGGYSSINNVQDPQKPEPRDKMESFFLGETLKYLFLLFSDDPNLLSLDAYVFNTEAHPLPIWTPA

SEQ ID NO: 1033242 - protein, 142 aa, Homo sapiens [sequence omitted]

SEQ ID NO: 1033243 - protein, 873 aa, Homo sapiens; identical to SEQ ID NO: 1033241

SEQ ID NO: 1033244 - protein, 172 aa, Homo sapiens
MAQQHARHGDAADYEFSSSFALPAFSVDSIFYITPWTDHWKALAFRLEEEQKMRPEIAGLKPANPPVLPAPQKADSDPENLPEISSQKTQRHIQRGPPHLQIRPPSQEDTNHDSRLLKPEQVSVGRPEGGFEVVPGTGVTEWTAQGAALPGLVKPQMSPIQGSGGAAVTPEA

SEQ ID NO: 1033245 - protein, 120 aa, Homo sapiens
MAQQHARHGDAADYEFSSSFALPAFSVDSIFYITPWTDHWKALAFRLEEEQKMRPEIAGLKPANPPVLPAPQKADTTLRTYLPGTGVTEWTAQGAALPGLVKPQMSPIQGSGGAAVTPEA

SEQ ID NO: 1033246 - protein, 122 aa, Homo sapiens
MAQQHARHGDAADYEFSSSFALPAFSVDSIFYITPWTDHWKALAFRLEEEQKMRPEIAGLKPANPPVLPAPQKADSDPENLPEISSQKTQRHIQRGPPHLQIRPPSQAPIQGSGGAAVTPEA

SEQ ID NO: 1033247 - protein, 631 aa, Homo sapiens; identical to SEQ ID NO: 1033240

SEQ ID NO: 1033248 - protein, 728 aa, Homo sapiens
MAQQHARHGDAADYEFSSSFALPAFSVDSIFYITPWTDHWKALAFRLEEEQKMRPEIAGLKPANPPVLPAPQKADSDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRPGRLRVQHRSPPSAYLDPCLGWMAAGVGTSGGQRHLAGSVAFSKGPRSTGNRQVAQALNWLWAPPRLCFNQDTVRTSEAVSLGVMRGGLGRWSLRLLPPEDTNHDSRLLKPEQVSVGRPEGGFEVVPGTGVTEWTAQGAALPGLVKPQMSPIQGSGGAAVTPEA

SEQ ID NO: 1033249 - protein, 421 aa, Homo sapiens
RALSAGSQSVLGRGEAELTEPLYSSPCSSALASKPTIPLSAAEAVEKVTQHIHGLSGKKDGLVPMFINTHSGLFTHLGVFTLGARADSYYEYLLKQWIQGGKQETQWRPGPPPAPAVPFPLPKPNSRTSPPPHSAGNRSRARPGPGGEGGGKHHTPPQGGRGGQHGPAAQGGTSPAAPAEAEEPDPKTPRPKHLSSEKTAGVHRLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 1033250 - protein, 873 aa, Homo sapiens; identical to SEQ ID NO: 1033241

SEQ ID NO: 1033251 - protein, 375 aa, Homo sapiens
MAQQHARHGDAADYEFSSSFALPAFSVDSIFYITPWTDHWKALAFRLEEEQKMRPEIAGLKPANPPVLPAPQKADSDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQVRGQAFWLMQPPWSYLMLITRWPQV

SEQ ID NO: 1033252 - protein, 172 aa, Homo sapiens; identical to SEQ ID NO: 1033244

SEQ ID NO: 1033253 - protein, 873 aa, Homo sapiens; identical to SEQ ID NO: 1033241

SEQ ID NO: 1033254 - protein, 902 aa, Homo sapiens
MAQQHARHGDAADYEFSSSFALPAFSVDSIFYITPWTDHWKALAFRLEEEQKMRPEIAGLKPANPPVLPAPQKADSDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKVGLGLGQGPSGGGCLAGLAFAPELCIRHQPADRHNLLRPETVESLFYLYRVTGDRKYQDWGWEILQSFSRFTRVSTCPRPAWSRPPGHRHGWAVGLRLAPLLVVAVTWVREGRACRSLGVATLQLGGPGIPIPTELHGCGTQSTWRGWAPLIFISQGLSREGLCCGPSIPPVEEAHAPMTGAPSPLWTRPCFRSRPPRQSVTSWLCCDLGLRPPLPPLPPSALCPVPCAATVRPPEPRFWGRRFLSWSLEGCWHFQVGSGGTTRLRLGVAIIQAPSTLSLRWGPHSLWGGERFGDEAEGGAGCPPCGDEALAAAQVPSGGYSSINNVQDPQKPEPRDKMESFFLGETLKYLFLLFSDDPNLLSLDAYVFNTEAHPLPIWTPA

SEQ ID NO: 1033255 - protein, 873 aa, Homo sapiens; identical to SEQ ID NO: 1033241

SEQ ID NO: 1033256 - protein, 152 aa, Homo sapiens
VVSSDVSPSLQLSCTASDPGWELTPAEKYQAVLSLCLKPRQCSHPIRKGLHHKILLANFLAQTEALMRGKSTEEARKELQAAGKSPEDLERLLPHKVSTSAFGFGVHAGVGGVKLWHQAGAWGMPGLSYRMGGPVLTDLHVSAPVAEEVDWY

SEQ ID NO: 1033257 - protein, 256 aa, Homo sapiens [sequence omitted]

SEQ ID NO: 1033258 - protein, 356 aa, Homo sapiens
SLFIIASKTFTTQETITNAEAGLIGEVLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1033259 - protein, 356 aa, Homo sapiens; identical to SEQ ID NO: 1033258

SEQ ID NO: 1033260 - protein, 117 aa, Homo sapiens
MDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQQESRGP

SEQ ID NO: 1033261 - protein, 327 aa, Homo sapiens
SLFIIASKTFTTQETITNAEAGLIGEVLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDPPYPANFGILSSEGVLPCWAGWS

SEQ ID NO: 1033262 - protein, 241 aa, Homo sapiens
DAPFVGLLVFVLLLWFETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1033263 - protein, 356 aa, Homo sapiens; identical to SEQ ID NO: 1033258

SEQ ID NO: 1033264 - protein, 356 aa, Homo sapiens; identical to SEQ ID NO: 1033258

SEQ ID NO: 1033265 - protein, 294 aa, Homo sapiens
GEHNLRLGTRPGWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1033266 - protein, 237 aa, Homo sapiens
MMWVHSTALPACETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1033267 - protein, 356 aa, Homo sapiens; identical to SEQ ID NO: 1033258

SEQ ID NO: 1033268 - protein, 338 aa, Homo sapiens
SLFIIASKTFTTQETITNAEAGLIGEVLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKTNGLINFIKQQREARVQ

SEQ ID NO: 1033269 - protein, 356 aa, Homo sapiens; identical to SEQ ID NO: 1033258

SEQ ID NO: 1033270 - protein, 356 aa, Homo sapiens; identical to SEQ ID NO: 1033258

SEQ ID NO: 1033271 - protein, 427 aa, Homo sapiens
MLSSQAAGLSAAGWDIYFMSRRKVWVFLRVQVGPRLCPSQLQSCFSPILGRVRSLHSGPPLTGGALSRSESSHVVSSGSPCSLPSLQKELCPLPTGRRVWPLLLTLLFVTGFDNFEQLLSGAHWMVVLRLVLCQVLARGACVGPGPPLSPPLSCPSPPRAAAQLPLILLLFQDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1033272 - protein, 167 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCVSIPDVVGWFVLFYKPGIVLLLALAKYLKMNNFL

SEQ ID NO: 1033273 - protein, 167 aa, Homo sapiens; identical to SEQ ID NO: 1033272

SEQ ID NO: 1033274 - protein, 167 aa, Homo sapiens; identical to SEQ ID NO: 1033272

SEQ ID NO: 1033275 - protein, 167 aa, Homo sapiens; identical to SEQ ID NO: 1033272

SEQ ID NO: 1033276 - protein, 919 aa, Homo sapiens
MAADVFMCSPRRPRSRGRQVLLKPQVSEDDDDSDTDEPSPPPASGAATPARAHASAAPPPPRAGPGREEPPGLQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDGQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 1033277 - protein, 919 aa, Homo sapiens; identical to SEQ ID NO: 1033276

SEQ ID NO: 1033278 - protein, 670 aa, Homo sapiens [sequence omitted]

SEQ ID NO: 1033279 - protein, 1022 aa, Homo sapiens
MAADVFMCSPRRPRSRGRQVLLKPQVSEDDDDSDTDEPSPPPASGAATPARAHASAAPPPPRAGPGREEPPGLQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQVGEPGSSEDPHLTGDSRDFGGPPGSPAKGGRPWALPGVSGMAQEAVQLSLLGGLEGAALQMPPPCCLTSTEHPFDEFPQVTGVGILRPTVLFDASSPVLVLCEDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDGQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 1033280 - protein, 526 aa, Homo sapiens [sequence omitted]

SEQ ID NO: 1033281 - protein, 772 aa, Homo sapiens
MAADVFMCSPRRPRSRGRQVLLKPQVSEDDDDSDTDEPSPPPASGAATPARAHASAAPPPPRAGPGREEPPGLQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDGQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLLLS

SEQ ID NO: 1033282 - protein, 628 aa, Homo sapiens
MAADVFMCSPRRPRSRGRQVLLKPQVSEDDDDSDTDEPSPPPASGAATPARAHASAAPPPPRAGPGREEPPGLQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDGQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPGEPGGETQCGAPPDPEGCFPIPKAFKLVTTTTTLVCTCMRTHIHLNETKVS

SEQ ID NO: 1033283 - protein, 871 aa, Homo sapiens
MAADVFMCSPRRPRSRGRQVLLKPQVSEDDDDSDTDEPSPPPASGAATPARAHASAAPPPPRAGPGREEPPGLQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQEESILPTTALPTVSLPDSLIAPPTAPSLAHMDGQGCEHTSRTEDPFIQPTDFGPSEPPLSVPQPFLPRVTISSSSCHCPEPPGSTHLPSATEVCWSNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 1033284 - protein, 919 aa, Homo sapiens; identical to SEQ ID NO: 1033276

SEQ ID NO: 1033285 - protein, 860 aa, Homo sapiens
MAADVFMCSPRRPRSRGRQVLLKPQVSEDDDDSDTDEPSPPPASGAATPARAHASAAPPPPRAGPGREEPPGLQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQVGEPGSSEDPHLNETAGTSVAHQGALQKDLFSSSRSIFGSMLPASASAPVPDPNNPPAQESILPTTALPTVSLPDSLIAPPTAPSLAHMDGQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 1033286 - protein, 207 aa, Homo sapiens
MAPADSAYSHSADYIVEILNLPDYPGLPTLRSSPDRAMRVLPQNGPLARTRLHRMREYRGNTHPGGTPTATAPQAHAPPIKQETKEIENQCKTADIQDKTNYSQHETQHQPTEAHTRPLAQTTQDTAHRPLTATCSQHTAGDTGPAGRRTVNPPTTPELRPTNAIKLTHRHTQPHLSASKTPKQEARDKRPCSNKLTRVTRIEHNYT

SEQ ID NO: 1033287 - protein, 119 aa, Homo sapiens
MTLIPPRAHVGSGAPFLQRLGVCQPVAASRGGVERKEWCGSWGERPFLPPSPTSTLSAASRVRKQVVNIPSFIVRLDSQKHIDFSLRSPYGGGRPGRVKRKNAKKGQGGAGAGDDEEED

SEQ ID NO: 1033288 - protein, 256 aa, Homo sapiens
MPVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVGDFWTVTRYQPSEVMGVNSARGYRLHLLVHQFTRKLGQGSGTPIGPARGSLRSRRTTCEGLLQACGELDRVRKQVVNIPSFIVRLDSQKHIDFSLRSPYGGGRPGRVKRKNAKKGQGGAGAGDDEEED

SEQ ID NO: 1033289 - protein, 194 aa, Homo sapiens [sequence omitted]

SEQ ID NO: 1033290 - protein, 194 aa, Homo sapiens [sequence omitted]

SEQ ID NO: 1033291 - protein, 216 aa, Homo sapiens
GRERTELRSCGKFWSPNNAFASGAGLVCGISTCEADKGPCREVWVTVLRELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVVIRTGPFRVRKQVVNIPSFIVRLDSQKHIDFSLRSPYGGGRPGRVKRKNAKKGQGGAGAGDDEEED

SEQ ID NO: 1033292 - protein, 194 aa, Homo sapiens [sequence omitted]

SEQ ID NO: 1033293 - protein, 403 aa, Homo sapiens
MTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIPEDGAADVRVIISNSAYGKFRKLFPG

SEQ ID NO: 1033294 - protein, 403 aa, Homo sapiens; identical to SEQ ID NO: 1033293

SEQ ID NO: 1033295 - protein, 551 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIPEDGAADVRVIISNSAYGKFRKLFPG

SEQ ID NO: 1033296 - protein, 563 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIAAWGAEALPLCWGQLGVRCSRVLLVWFCTRLAPSHLLG

SEQ ID NO: 1033297 - protein, 596 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTGGSVQTCSFPKPPFLSAATENIQPRHAEVRGSCGARGEAGLSDCPEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIPEDGAADVRVIISNSAYGKFRKLFPG

SEQ ID NO: 1033298 - protein, 424 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTTVQEVDVIPEDGAADVRVIISRVLLVWFCTRLAPSHLLG

SEQ ID NO: 1033299 - protein, 494 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTATRDAASALTSCRGTMGSFQLRRPLESFRTVKWPSALPLPLGSWPPQGGPSKYAQAQRMTEMPPPWQRRRGNNGTDVRDNPERSGTSSEHQPKTDGEREHTCSPLRDSEKETTTESGRWCPLAVIA

SEQ ID NO: 1033300 - protein, 238 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRAGR

SEQ ID NO: 1033301 - protein, 171 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRGDRGRAFGGETGAGDLGAGL

SEQ ID NO: 1033302 - protein, 629 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGEHAPRGGAFRGLRVTGEDSPGGGQGVPVVSVVPYDSCGDTCPGEGVPMVAVWGTPAAVRAHPGDGFPVVSVWGTAAKVKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIPEDGAADVRVIISNSAYGKFRKLFPG

SEQ ID NO: 1033303 - protein, 580 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIRGGFGGGKKTPGFGYLPPPWRKGGGKNPRPEDGAADVRVIISNSAYGKFRKLFPG

SEQ ID NO: 1033304 - protein, 419 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTTVQEVDVIPEDGAADVRVIISNSAYGKFRKLFPG

SEQ ID NO: 1033305 - protein, 527 aa, Homo sapiens
GEALVSQPRPHANHEHVMRSGLWAAPAPTFSLRRAMWALRAAVRPGLRLSRVGRGRSAPRAAAPSCPARALAAVGRRSPGNLEGPWGGGRGLRADGGRSRTGDDEEEPEDADENAEEELLRGEPLLPAGTQRVCLVHPDVKWGPGKSQMTRAEWQVAEATALVHTLDGWSVVQTMVVSTKTPDRKLIFGKGNFEHLTEKIRGSPDVTCVFLNVERMAAPTKKELEAAWGVEVFDRFTVVLHIFRCNARTKEARLQVALAEMPLHRSNLKRDVAHLYRGVGSRYIMGSGESFMQLQQRLLREKEAKIRKALDRLRKKRHLLRRQRTRREFPVISVVGYTNCGEHAPRGGAFRGLRVTGEDSPGGGQGVPVVSVVPYDSCGEHVPRRGGSHGRRVGYTSCCESSPRRRVSCGLCVGYSSQGEDVIYPILPSRALPPCLYHNLPSIYTILLSRPSPLPYLYHHPVYTIHPSTPSPLLCLYHPPVYTSTTTPSIPPPRLHNPPVYTINVPFVCTVLLSTLHHMPHLYHTHP

SEQ ID NO: 1033306 - protein, 163 aa, Homo sapiens
GEALVSQPRPHANHEHVMRSGLWAAPAPTFSLQTRHVGPAGRRTPGAAALPRGPRPLGSAGSRAVLPRARASRCRPQEPRESGGAVGRRAGPAGGRRPKPHGSSFQDERTPTEACGVGASLPGELRRYRCVGGSLVSGAAGSSLSGSAPVSLPAICWDDRAGR

SEQ ID NO: 1033307 - protein, 403 aa, Homo sapiens; identical to SEQ ID NO: 1033293

SEQ ID NO: 1033308 - protein, 138 aa, Homo sapiens
MRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 1033309 - protein, 161 aa, Homo sapiens
MQTGGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGQP

SEQ ID NO: 1033310 - protein, 175 aa, Homo sapiens
MQTGGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 1033311 - protein, 175 aa, Homo sapiens; identical to SEQ ID NO: 1033310

SEQ ID NO: 1033312 - protein, 175 aa, Homo sapiens; identical to SEQ ID NO: 1033310

SEQ ID NO: 1033313 - protein, 516 aa, Homo sapiens
MEREPGAAGVRRALGRRLEAVLASRSEANAVFDILAVLQSEDQEEIQEAVRTCSRLFGALLERGELFVGQLPSEEMVMTGSQGATRKYKVWMRHRYHSCCNRLGELLGHPSFQVKELALSALLKFVQLEGAHPLEKSKWEGNYLFPRELFKLVVGGLLSPEEDQSLLLSQFREYLDYDDTRYHTMQAAVDAVARVTGQHPEVPPAFWNNAFTLLSAVSLPRREPTVSSFYVKRAELWDTWKVAHLKEHRRVFQAMWLSFLKHKLPLSLYKKVLLIVHDAILPQLAQPTLMIDFLTRACDLGGALSLLALNGLFILIHKHNLEYPDFYRKLYGLLDPSVFHVKYRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKKKGPEPVPLEFIPAQGLLGRPGELCAQHFTLS

SEQ ID NO: 1033314 - protein, 552 aa, Homo sapiens
MEREPGAAGVRRALGRRLEAVLASRSEANAVFDILAVLQSEDQEEIQEAVRTCSRLFGALLERGELFVGQLPSEEMVMTGSQGATRKYKVWMRHRYHSCCNRLGELLGHPSFQVKELALSALLKFVQLEGAHPLEKSKWEGNYLFPRELFKLVVGGLLSPEEDQSLLLSQFREYLDYDDTRYHTMQAAVDAVARVTGQHPEVGDGVLSPASCCCLPGRQALGGGVRHSGQAPAVCPPAFLEQLASTACLSLPEALARREPTVSSFYVKRAELWDTWKVAHLKEHRRVFQAMWLSFLKHKLPLSLYKKVLLIVHDAILPQLAQPTLMIDFLTRACDLGGALSLLALNGLFILIHKHNLEYPDFYRKLYGLLDPSVFHVKYRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKKKGPEPVPLEFIPAQGLLGRPGELCAQHFTLS

SEQ ID NO: 1033315 - protein, 516 aa, Homo sapiens; identical to SEQ ID NO: 1033313

SEQ ID NO: 1033316 - protein, 314 aa, Homo sapiens
MEREPGAAGVRRALGRRLEAVLASRSEANAVFDILAVLQSEDQEEIQEAVRTCSRLFGALLERGELFVGQLPSEEMVMTGSQGATRKYKVWMRHRYHSCCNRLGELLGHPSFQVKELALSALLKFVQLEGAHPLEKSKWEGNYLFPRELFKLVVGGLLSPEEDQSLLLSQFREYLDYDDTRYHTMQAAVDAVARVTGQHPEVPPAFWNNAFTLLSAVSLPRREPTVSSFYVKRAELWDTWKVAHLKEHRRVFQAMWLSFLKHKLPLSLYKKVLLIVHDAICEVGQPVMIDSQPAGPRGAHCGLTVSLMKKLDTD

SEQ ID NO: 1033317 - protein, 258 aa, Homo sapiens
VQHRGCGRGQQGQRHTPQTYTQCGQGVGWERGHCSSLCLSVRRGALSLLALNGLFILIHKHNLEYPDFYRKLYGLLDPSVFHVKYRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKKKGPEPVPLEFIPAQGLLGRPGELCAQHFTLS

SEQ ID NO: 1033318 - protein, 516 aa, Homo sapiens; identical to SEQ ID NO: 1033313

SEQ ID NO: 1033319 - protein, 182 aa, Homo sapiens
MIRSDLFPHRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKKKGPEPVPLEFIPAQGLLGRPGELCAQHFTLS

SEQ ID NO: 1033320 - protein, 688 aa, Homo sapiens
LAEQLKQAEELRQYKVLVHSQERELTQLKEKLQEGRDASRSLNEHLQALLTLDEPDKSQGQDLQEQLAEGCRLAQHLVQKAQPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDSEYLTVKVISLHLVFQIGVIFLFQVALTDPRDVIAAGRTYGRI

SEQ ID NO: 1033321 - protein, 867 aa, Homo sapiens
LAEQLKQAEELRQYKVLVHSQERELTQLKEKLQEGRDASRSLNEHLQALLTLDEPDKSQGQDLQEQLAEGCRLAQHLVQKLQPREVQKAEESKVPEDSLEECAITCSNSHGPCDSNQPHKNIKITFEEDEVNSTLVVDRESSHDECQDALNILSVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRPGSAGSCWMRKSLKSCRTHWIDVIRLLQVILNCLT

SEQ ID NO: 1033322 - protein, 688 aa, Homo sapiens; identical to SEQ ID NO: 1033320

SEQ ID NO: 1033323 - protein, 921 aa, Homo sapiens
MLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVNMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGCLELTDSCQPYRSAFYILEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 1033324 - protein, 688 aa, Homo sapiens; identical to SEQ ID NO: 1033320

SEQ ID NO: 1033325 - protein, 671 aa, Homo sapiens
LAEQLKQAEELRQYKVLVHSQERELTQLKEKLQEGRDASRSLNEHLQALLTLDEPDKSQGQDLQEQLAEGCRLAQHLVQKAQPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDTELKRTKKRKKTKAHHAPGSAGSCWR

SEQ ID NO: 1033326 - protein, 921 aa, Homo sapiens; identical to SEQ ID NO: 1033323

SEQ ID NO: 1033327 - protein, 921 aa, Homo sapiens; identical to SEQ ID NO: 1033323

SEQ ID NO: 1033328 - protein, 762 aa, Homo sapiens
LAEQLKQAEELRQYKVLVHSQERELTQLKEKLQEGRDASRSLNEHLQALLTLDEPDKSQGQDLQEQLAEGCRLAQHLVQKLQPREVQKAEESKVPEDSLEECAITCSNSHGPCDSNQPHKNIKITFEEDEVNSTLVVDRESSHDECQDALNILSVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEPEVLQDSLDRCYSTPSMYFELPDSFQHYRSVFYSFEEQHISFALYVDNRFFTLTVTSLHLVFQMGVIFPQ

SEQ ID NO: 1033329 - protein, 1156 aa, Homo sapiens
LAEQLKQAEELRQYKVLVHSQERELTQLKEKLQEGRDASRSLNEHLQALLTLDEPDKSQGQDLQEQLAEGCRLAQHLVQKLQPREVQKAEESKVPEDSLEECAITCSNSHGPCDSNQPHKNIKITFEEDEVNSTLVVDRESSHDECQDALNILSVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGCLELTDSCQPYRSAFYILEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDRCYSTPSMYFELPDSFQHYRSVFYSFEEQHISFALYVDNRFFTLTVTSLHLVFQMGVIFPQ

SEQ ID NO: 1033330 - protein, 688 aa, Homo sapiens; identical to SEQ ID NO: 1033320

SEQ ID NO: 1033331 - protein, 1156 aa, Homo sapiens; identical to SEQ ID NO: 1033329

SEQ ID NO: 1033332 - protein, 1156 aa, Homo sapiens; identical to SEQ ID NO: 1033329

SEQ ID NO: 1033333 - protein, 1156 aa, Homo sapiens; identical to SEQ ID NO: 1033329

SEQ ID NO: 1033334 - protein, 867 aa, Homo sapiens; identical to SEQ ID NO: 1033321

SEQ ID NO: 1033335 - protein, 792 aa, Homo sapiens
LAEQLKQAEELRQYKVLVHSQERELTQLKEKLQEGRDASRSLNEHLQALLTLDEPDKSQGQDLQEQLAEGCRLAQHLVQKLQPREVQKAEESKVPEDSLEECAITCSNSHGPCDSNQPHKNIKITFEEDEVNSTLVVDRESSHDECQDALNILSVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRPGSAGSCWMRKSLKSCRTHWIDVIRLLQVILNCLT

SEQ ID NO: 1033336 - protein, 688 aa, Homo sapiens; identical to SEQ ID NO: 1033320

SEQ ID NO: 1033337 - protein, 1081 aa, Homo sapiens
LAEQLKQAEELRQYKVLVHSQERELTQLKEKLQEGRDASRSLNEHLQALLTLDEPDKSQGQDLQEQLAEGCRLAQHLVQKLQPREVQKAEESKVPEDSLEECAITCSNSHGPCDSNQPHKNIKITFEEDEVNSTLVVDRESSHDECQDALNILSVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSGELLDEKEPEVLQESLDRCYSTPSGCLELTDSCQPYRSAFYILEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDRCYSTPSMYFELPDSFQHYRSVFYSFEEQHISFALYVDNRFFTLTVTSLHLVFQMGVIFPQ

SEQ ID NO: 1033338 - protein, 663 aa, Homo sapiens
LAEQLKQAEELRQYKVLVHSQERELTQLKEKLQEGRDASRSLNEHLQALLTLDEPDKSQGQDLQEQLAEGCRLAQHLVQKAQPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPR

SEQ ID NO: 1033339 - protein, 1155 aa, Homo sapiens
LAEQLKQAEELRQYKVLVHSQERELTQLKEKLQEGRDASRSLNEHLQALLTLDEPDKSQGQDLQEQLAEGCRLAQHLVQKLQPREVQKAEESKVPEDSLEECAITCSNSHGPCDSNQPHKNIKITFEEDEVNSTLVVDRESSHDECQDALNILSVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGCLELTDSCQPYRSAFYILEQQRVGLAVDMDEIEKYQEVEEDQDPSCPRLSRELLDEKEPEVLQDSLDRCYSTPSGYLELPDLGQPYSSAVYSLEEQYLGLALDVDRIKRTKKRKKTKATMPQVSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDRCYSTPSMYFELPDSFQHYRSVFYSFEEQHISFALYVDNRFFTLTVTSLHLVFQMGVIFPQ

SEQ ID NO: 1033340 - protein, 616 aa, Homo sapiens
LAEQLKQAEELRQYKVLVHSQERELTQLKEKLQEGRDASRSLNEHLQALLTLDEPDKSQGQDLQEQLAEGCRLAQHLVQKAQPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDMLFNSFRLS

SEQ ID NO: 1033341 - protein, 688 aa, Homo sapiens; identical to SEQ ID NO: 1033320

SEQ ID NO: 1033342 - protein, 668 aa, Homo sapiens
LAEQLKQAEELRQYKVLVHSQERELTQLKEKLQEGRDASRSLNEHLQALLTLDEPDKSQGQDLQEQLAEGCRLAQHLVQKAQPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPQQGAAG

SEQ ID NO: 1033343 - protein, 843 aa, Homo sapiens
LAEQLKQAEELRQYKVLVHSQERELTQLKEKLQEGRDASRSLNEHLQALLTLDEPDKSQGQDLQEQLAEGCRLAQHLVQKAQPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRTFSNCGCLILC

SEQ ID NO: 1033344 - protein, 1156 aa, Homo sapiens; identical to SEQ ID NO: 1033329

SEQ ID NO: 1033345 - protein, 1156 aa, Homo sapiens; identical to SEQ ID NO: 1033329

SEQ ID NO: 1033346 - protein, 1156 aa, Homo sapiens; identical to SEQ ID NO: 1033329

SEQ ID NO: 1033347 - protein, 1156 aa, Homo sapiens; identical to SEQ ID NO: 1033329

SEQ ID NO: 1033348 - protein, 932 aa, Homo sapiens
LAEQLKQAEELRQYKVLVHSQERELTQLKEKLQEGRDASRSLNEHLQALLTLDEPDKSQGQDLQEQLAEGCRLAQHLVQKAQPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGCLELTDSCQPYRSAFYILEQQRVGLAVDMDRIKKDQEEEEDQGPPCPRLSRELLEVVEPEVLQLTDRGAELDS

SEQ ID NO: 1033349 - protein, 688 aa, Homo sapiens; identical to SEQ ID NO: 1033320

SEQ ID NO: 1033350 - protein, 921 aa, Homo sapiens; identical to SEQ ID NO: 1033323

SEQ ID NO: 1033351 - protein, 921 aa, Homo sapiens; identical to SEQ ID NO: 1033323

SEQ ID NO: 1033352 - protein, 921 aa, Homo sapiens; identical to SEQ ID NO: 1033323

SEQ ID NO: 1033353 - protein, 867 aa, Homo sapiens; identical to SEQ ID NO: 1033321

SEQ ID NO: 1033354 - protein, 768 aa, Homo sapiens
LAEQLKQAEELRQYKVLVHSQERELTQLKEKLQEGRDASRSLNEHLQALLTLDEPDKSQGQDLQEQLAEGCRLAQHLVQKLQPREVQKAEESKVPEDSLEECAITCSNSHGPCDSNQPHKNIKITFEEDEVNSTLVVDRESSHDECQDALNILSVPGPTSSATNVSMVVSAGPLSSEKAEMNILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRTFSNCGCLILC

SEQ ID NO: 1033355 - protein, 688 aa, Homo sapiens; identical to SEQ ID NO: 1033320

SEQ ID NO: 1033356 - protein, 921 aa, Homo sapiens; identical to SEQ ID NO: 1033323

SEQ ID NO: 1033357 - protein, 104 aa, Homo sapiens
MPRVAPNTRNTYHQHELPLSAHPPPKALPAGFDGVMSHRKFSAPRHGSLGFLPRKRSSRHRGKVKSFPKDDPSKPVHLTAFLGYKAGMTHIVRECRQAGIQGEQ

SEQ ID NO: 1033358 - protein, 133 aa, Homo sapiens
MARSSWRKDFSSMKKYCQVIRVIAHTQMRLLPLRQKKAHLMEIQVNGGTVAEKLDWARERLEQQVPVNQVFGQDEMIDVMDEIIHLIRGSQGAGFKRGTNSVGPPRCPKRHPGLAKGGLYWGLDPLRSFSWGP

SEQ ID NO: 1033359 - protein, 104 aa, Homo sapiens; identical to SEQ ID NO: 1033357

SEQ ID NO: 1033360 - protein, 104 aa, Homo sapiens; identical to SEQ ID NO: 1033357

SEQ ID NO: 1033361 - protein, 104 aa, Homo sapiens; identical to SEQ ID NO: 1033357

SEQ ID NO: 1033362 - protein, 104 aa, Homo sapiens
MLKGCVVGTQKEAGAHPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 1033363 - protein, 274 aa, Homo sapiens
MTHESCGLVDAKTASSYNEFWANTQFLKKVHGLFNQRYLRRDYCAGMMAWHTYTLLGKDVVGLNTYCLWLVRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTQKAGAHPPQVLAGADEAAGSGED

SEQ ID NO: 1033364 - protein, 123 aa, Homo sapiens
MANWVARRLQTSTGGSPGGTKAHVEGTWKSGNWVPITCAGFEAPRCAAQKGGPVNDKREGFQTAEDTSFSGTNQPRKGKRPWTPTVHHGSPPIAWTGPPCPGPKRARGPRGLPARGGATWGTF

SEQ ID NO: 1033365 - protein, 88 aa, Homo sapiens
RCSGVSSYGEDDPMTFLAEEAVWWEQKRVLTLRKSLLVQTKRRALEKIDLKFIDTTSKFGHGRFQTMEEKKAFMGPLKKDRIAKEEGA

SEQ ID NO: 1033366 - protein, 104 aa, Homo sapiens; identical to SEQ ID NO: 1033362

SEQ ID NO: 1033367 - protein, 223 aa, Homo sapiens
MARSSWRKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTQKAGAHPPQVLAGADEAAGSGED

SEQ ID NO: 1033368 - protein, 104 aa, Homo sapiens; identical to SEQ ID NO: 1033357

SEQ ID NO: 1033369 - protein, 655 aa, Homo sapiens
MTNFISGLQRLHGMLEFLRPSSSNHSVGPMRTRRRVSASRRARAGGSQRTDSARLRAPLDAYFQVSRTQPDLPATTYDSETRNPVSEELQVSSSSDSDSDSSAEYGGVVDQAEESGAVILEEQLAGVSAEQEVTCIDGGKTLPKQPSPQKSEPLLPSASMDEEEGDTCTICLEQWTNAGDHRLSALRCGHLFGYRCISTWLKGQVRKCPQCNKKARHSDIVVLYARTLRALDTSEQERMKSSLLKEQMLRKQAELESAQCRLQLQVLTDKCTRLQRRVQDLQKLTSHQSQNLQQPRGSQAWVLSCSPSSQGQHKHKYHFQKTFTVSQAGNCRIMAYCDALSCLVISQPSPQASFLPGFGVKMLSTANMKSSQYIPMHGKQIRGLAFSSYLRGLLLSASLDNTIKLTSLETNTVVQTYNAGRPVWSCCWCLDEANYIYAGLANGSILVYDVRNTSSHVQELVAQKARCPLVSLSYMPRAASAAFPYGGVLAGTLEDASFWEQKMDFSHWPHVLPLEPGGCIDFQTENSSRHCLVTYRPDKNHTTIRSVLMEMSYRLDDTGNPICSCQPVHTFFGGPTCKLLTKNAIFQSPENDGNILVCTGDEAANSALLWDAASGSLLQDLQTDQPVLDICPFEVNRNSYLATLTEKMVHIYKWE

SEQ ID NO: 1033370 - protein, 69 aa, Homo sapiens
LPEPACLAADALSADSTRSAWFRPLSAYVVRGPYVLRPVETQALSVRGDTPFDMLMIKSGCPGLVSVAE

SEQ ID NO: 1033371 - protein, 294 aa, Homo sapiens [sequence omitted]

SEQ ID NO: 1033372 - protein, 692 aa, Homo sapiens
MAHEAMEYDVQVQLNHAEQQPAPAGMASSQGGPALLQPVPADVVSSQEVPSILQPAPAEVISSQATPPLLQPAPQLSVDLTEVEVLGEDTVENINPRTSEQHRQGSDGNHTIPASSLHSMTNFISGLQRLHGMLEFLRPSSSNHSVGPMRTRRRVSASRRARAGGSQRTDSARLRAPLDAYFQVSRTQPDLPATTYDSETRNPVSEELQVSSSSDSDSDSSAEYGGVVDQAEESGAVILEEQLAGVSAEQEVTCIDGGKTLPKQPSPQKSEPLLPSASMDEEEGDTCTICLEQWTNAGDHRLSALRCGHLFGYRCISTWLKGQVRKCPQCNKKARHSDIVVLYARTLRALDTSEQERMKSSLLKEQMLRKQAELESAQCRLQLQVLTDKCTRLQRRVQDLQKLTSHQSQNLQQPRGSQAWVLSCSPSSQGQHKHKYHFQKTFTVSQAGNCRIMAYCDALSCLVISQPSPQASFLPGFGVKMLSTANMKSSQYIPMHGKQIRGLAFSSYLRGLLLSASLDNTIKLTSLETNTVVQTYNAGRPVWSCCWCLDEANYIYAGLANGSILVYDVRNTSSHVQELVAQKARCPLVSLSYMPRAASAAFPYGGVLAGTLEDASFWEQKMDFSHWPHVLPLEPGGCIDFQTENSSRHCLVTYRPDKNHTTIRSVLMEMSYRLDDTGLGLLASSNPPTSAS

SEQ ID NO: 1033373 - protein, 417 aa, Homo sapiens
MKSSLLKEQMLRKQAELESAQCRLQLQVLTDKCTRLQRRVQDLQKLTSHQSQNLQQPRGSQAWVLSCSPSSQGQHKHKYHFQKTFTVSQAGNCRIMAYCDALSCLVISQPSPQASFLPGFGVKMLSTANMKSSQYIPMHGKQIRGLAFSSYLRGLLLSASLDNTIKLTSLETNTVVQTYNAGRPVWSCCWCLDEANYIYAGLANGSILVYDVRNTSSHVQELVAQKARCPLVSLSYMPRAASAAFPYGGVLAGTLEDASFWEQKMDFSHWPHVLPLEPGGCIDFQTENSSRHCLVTYRPDKNHTTIRSVLMEMSYRLDDTGNPICSCQPVHTFFGGPTCKLLTKNAIFQSPENDGNILVCTGDEAANSALLWDAASGSLLQDLQTDQPVLDICPFEVNRNSYLATLTEKMVHIYKWE

SEQ ID NO: 1033374 - protein, 417 aa, Homo sapiens; identical to SEQ ID NO: 1033373

SEQ ID NO: 1033375 - protein, 417 aa, Homo sapiens; identical to SEQ ID NO: 1033373

SEQ ID NO: 1033376 - protein, 266 aa, Homo sapiens
MVFDFLNAVVKVFCNIHSLETNTVVQTYNAGRPVWSCCWCLDEANYIYAGLANGSILVYDVRNTSSHVQELVAQKARCPLVSLSYMPRAASAAFPYGGVLAGTLEDASFWEQKMDFSHWPHVLPLEPGGCIDFQTENSSRHCLVTYRPDKNHTTIRSVLMEMSYRLDDTGNPICSCQPVHTFFGGPTCKLLTKNAIFQSPENDGNILVCTGDEAANSALLWDAASGSLLQDLQTDQPVLDICPFEVNRNSYLATLTEKMVHIYKWE

SEQ ID NO: 1033377 - protein, 762 aa, Homo sapiens
RSGCWRSPGGGEGCRCLGRRIPEGVVSAPPRPPSPQIAHRSSCVHPRSRQPLAPGLAGRVSGIMCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 1033378 - protein, 681 aa, Homo sapiens
MCGIFAYLNYHVPRTRREILETLIKGLQRLEYRGYDSAGVGFDGGNDKDWEANACKTQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 1033379 - protein, 639 aa, Homo sapiens
RSGCWRSPGGGEGCRCLGRRIPEGVVSAPPRPPSPQIAHRSSCVHPRSRQPLAPGLAGRVSGIMCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAALLC

SEQ ID NO: 1033380 - protein, 681 aa, Homo sapiens; identical to SEQ ID NO: 1033378

SEQ ID NO: 1033381 - protein, 112 aa, Homo sapiens
RGGCWRSPGGGEGCRCLGRRIPEGVVSAPPRPPSPQIAHRSSCVHPRSRQPLAPGLAGRVSGIMCGIFAYLNYHVPRTRREILETLIKGLQRLEYRGYDSAGTLKKILMDFA

SEQ ID NO: 1033382 - protein, 798 aa, Homo sapiens
RGGCWRSPGGGEGCRCLGRRIPEGVVSAPPRPPSPQIAHRSSCVHPRSRQPLAPGLAGRVSGIMCGIFAYLNYHVPRTRREILETLIKGLQRLEYRGYDSADLSPKLYSRPPTSFFLDDHDILNFACSKIELRPGVVTTPVIPALWEAEVDGSLGGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 1033383 - protein, 681 aa, Homo sapiens; identical to SEQ ID NO: 1033378

SEQ ID NO: 1033384 - protein, 768 aa, Homo sapiens
SSGINAECPLRPEESLRRSVGTVWVSESKPTLLTITYNPFLFKMPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKTHCQEGALSSSLSWQKTRENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 1033385 - protein, 292 aa, Homo sapiens
ANGCARDSDVETPLNGFGWSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 1033386 - protein, 768 aa, Homo sapiens; identical to SEQ ID NO: 1033384

SEQ ID NO: 1033387 - protein, 619 aa, Homo sapiens
SSGINAECPLRPEESLRRSVGTVWVSESKPTLLTITYNPFLFKMPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKTHCQEGALSSSLSWQKTRENYKKFYEAFSKNLKLGIHEDSTNRRRLSELLRYHTSQSGDEMTSLSEYVSRMKETQKSIYYITGESKEQVANSAFVERVPRAPVPPGSPCWCLVFFSLSCPCVEGSKLRVSSPIPSLLLTAGLDVGYWGLFYSAFVLNKCTGAAGVVWGWG

SEQ ID NO: 1033388 - protein, 623 aa, Homo sapiens
SSGINAECPLRPEESLRRSVGTVWVSESKPTLLTITYNPFLFKMPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKTHCQEGALSSSLSWQKTRENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKERNLGQRRSQSAKFENLCNGLQLEKTEKS

SEQ ID NO: 1033389 - protein, 148 aa, Homo sapiens
AESARTTLGWSVIDLQVLFGHYIANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 1033390 - protein, 367 aa, Homo sapiens
ESRAPGGNVRWRSSNAKRWYESVADFGSGLCSSRDRLVELLRVVGQDAEYQNLQRQFPPGLISENVLTAWAWSYAKVVNYTFSNQETLCATLVTVYRGEDVYHCPDWFLAKINDNLMELVIMINACKMASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 1033391 - protein, 367 aa, Homo sapiens; identical to SEQ ID NO: 1033390

SEQ ID NO: 1033392 - protein, 367 aa, Homo sapiens; identical to SEQ ID NO: 1033390

SEQ ID NO: 1033393 - protein, 367 aa, Homo sapiens; identical to SEQ ID NO: 1033390

SEQ ID NO: 1033394 - protein, 266 aa, Homo sapiens
GQTYGHAGPPLQPLSIQPHLWTQPARRSRALLRTDGHQGMAWAGPGLPPHSSPLGRQPDAREGGPAMRACTPEAAPLSTAGPPDSLTQASPYQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDAHRAGIPRVTVG

SEQ ID NO: 1033395 - protein, 169 aa, Homo sapiens
TDSSTNTGYIELRVLSSDDTAVYYCARDVRGDTSMIVVDFPPLDHWGQGTLVHGHRLLSIPDQPQGLPAEPPLTAPSQDGNVVIACLVQGFFPQEPLSVTWSESGQGVTARNFPPSQDASGDLYTTSSQLTLPATQCLADGKSVTCHVSSTTRIADSIVPVSKPRPTKS

SEQ ID NO: 1033396 - protein, 102 aa, Homo sapiens
VFYCARLISWGCLGPCAIDFWGQGTMVTVSSASPTSPKVFPLSLAAPPRWERGHRLPGPGLLPPGATQCDLERKRTGRDRQKLPTQPDAYRGPMYEKGIPQG

SEQ ID NO: 1033397 - protein, 336 aa, Homo sapiens
PCITCARGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033398 - protein, 317 aa, Homo sapiens
MVPLTLGPGTLGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033399 - protein, 342 aa, Homo sapiens
NSLRTEDTGIYYCIRDSRGGYSSGYPRFDPWGQGTLGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033400 - protein, 324 aa, Homo sapiens
AFTPWTKTGYFTTGVGNPGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033401 - protein, 336 aa, Homo sapiens; identical to SEQ ID NO: 1033397

SEQ ID NO: 1033402 - protein, 252 aa, Homo sapiens
SSVPPRLARQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033403 - protein, 163 aa, Homo sapiens
MSFSKADITRLCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033404 - protein, 336 aa, Homo sapiens; identical to SEQ ID NO: 1033397

SEQ ID NO: 1033405 - protein, 336 aa, Homo sapiens; identical to SEQ ID NO: 1033397

SEQ ID NO: 1033406 - protein, 291 aa, Homo sapiens
PCITCARGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGKLGPLKRRLGEG

SEQ ID NO: 1033407 - protein, 172 aa, Homo sapiens
MPREALHESQPGCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQLALNELVTLNVPGTRLQPPRTCWFAGCRGHRSCPARST

SEQ ID NO: 1033408 - protein, 255 aa, Homo sapiens
PCITCARGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPESKTPHR

SEQ ID NO: 1033409 - protein, 249 aa, Homo sapiens
PCITCARGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWKPWEVLLVEGYQLI

SEQ ID NO: 1033410 - protein, 213 aa, Homo sapiens
AVYYLCAGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDAHRAGIPRVTVG

SEQ ID NO: 1033411 - protein, 163 aa, Homo sapiens
REIESARGILLAGPRPTTVWTSGAKGPLVTVSSASPTSPKVFPLSLAAPPRWERGHRLPGPGLLPPGATQCDLERKRTGRDRQKLPTQPGRSPARAPPHPFAVTSILRVAAEDWKKGDTFLLHGWATRPCRWPSHRRPSTAWRGKPTHVNVSVVMAEVDGTCY

SEQ ID NO: 1033412 - protein, 41 aa, Homo sapiens
MPREALHESQPGCDCALPSSLNSTYLLRGYSRITISITVHC

SEQ ID NO: 1033413 - protein, 104 aa, Homo sapiens
MYCALPSSPPPPCCHPRLSLHRPALEDLLLGSEANLTCTLTGLRDASGVTFTWDALKVGRALFKDHLRRDLCGCYSVSSVQPRQCTMPRNNGETVFPHCKRNTP

SEQ ID NO: 1033414 - protein, 69 aa, Homo sapiens
MPREALHESQPGCTVNALSSLNSTYPISLNSTYPISLIAKTSSQDYGKCPRCGYGCTTDSWLLCSHCAL

SEQ ID NO: 1033415 - protein, 116 aa, Homo sapiens
KEGTTTSGWYGSFDYWGQGTWSLGHRLLSIPDQPQGLPAEPPLTAPSQDGNVVIACLVQGFFPQEPLSVKTLGLVGDAEGDIVTRVTWPPGVEVVMGEKLFVDKGAKGVHVIRRLY

SEQ ID NO: 1033416 - protein, 152 aa, Homo sapiens
MGETRRIVAPGPCTTGSREPVVTVSSASPTSPKVFPLSLQHPPDGNVVIACLVQGFFPQEPLSVTWSESGQGVTARNFPPSQDASGDLYTTSSQLTLPATQCLADGKSVTCHVKHYTNPSQDVYDCSLPVPINSTYPMVLSIPYSYPGAELI

SEQ ID NO: 1033417 - protein, 159 aa, Homo sapiens
LGIGRKVNIKEVYTFASEPNDVFFKLVDKSTELNEEPLMRFGRLLPSFVSSENAFYLSPDIRKQCDWFQGDQPTKNLVKFGHKQVEVIIIIVLKIVALQGMHRSSNHPLTLYPDAVNCPDAVNCPDAVNCPDAVNCPDAVNCPDAVNCPDAVNCPDAVN

SEQ ID NO: 1033418 - protein, 333 aa, Homo sapiens
RDRVGERDSSGWSPAHNGMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033419 - protein, 334 aa, Homo sapiens
VKSDDTAVYYCVRDGRGWSFDLWGQGARGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033420 - protein, 336 aa, Homo sapiens; identical to SEQ ID NO: 1033397

SEQ ID NO: 1033421 - protein, 323 aa, Homo sapiens
MRALTATPQEMTGARNPGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033422 - protein, 331 aa, Homo sapiens
REIESARGILLAGPRPTTVWTSGAKGPLVTVSSASPTSPKVFPLSLQHPPDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033423 - protein, 376 aa, Homo sapiens
GQTYGHAGPPLQPLSIQPHLWTQPARRSRALLRTDGHQGMAWAGPGLPPHSSPLGRQPDAREGGPAMRACTPEAAPLSTAGPPGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPPPPPCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033424 - protein, 210 aa, Homo sapiens
MPREALHESQPGCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033425 - protein, 336 aa, Homo sapiens; identical to SEQ ID NO: 1033397

SEQ ID NO: 1033426 - protein, 336 aa, Homo sapiens; identical to SEQ ID NO: 1033397

SEQ ID NO: 1033427 - protein, 336 aa, Homo sapiens; identical to SEQ ID NO: 1033397

SEQ ID NO: 1033428 - protein, 297 aa, Homo sapiens
PCITCARGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPESKTPREVPDCATRPCRWPSHRRPSTAWRGKPTHVNVSVVMAEVDGTCY

SEQ ID NO: 1033429 - protein, 237 aa, Homo sapiens
PCITCARGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPTVE

SEQ ID NO: 1033430 - protein, 224 aa, Homo sapiens
PCITCARGGYDFRRPKFYYYSMDVWGQGTTGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWGRPSSGEGAVFQGTNLSVELLLGC

SEQ ID NO: 1033431 - protein, 135 aa, Homo sapiens
MVPLTLGPGTLGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPPPPTILSPSTEA

SEQ ID NO: 1033432 - protein, 35 aa, Homo sapiens
MPREALHESQPGCDCALPSSLNSTDPTPRQSVSAE

SEQ ID NO: 1033433 - protein, 107 aa, Homo sapiens
MPREALHESQPGCPPPPCCHPRLSLHRPALEDLLLGSEANLTCTLTGLRDASGVTFTWDALKVGRALFKDHLRRDLCGCYSVSSVLPGVAQPGKQWRNHSQRETWRK

SEQ ID NO: 1033434 - protein, 104 aa, Homo sapiens
REIESARGILLAGPRPTTVWTSGAKGPLVTVSSASPTSPKVFPLSLAAPPRWERGHRLPGPGLLPPGATQCDLERKRTGRDRQKLPTQPDAYRGPMYEKGIPQG

SEQ ID NO: 1033435 - protein, 329 aa, Homo sapiens
KEGTTTSGWYGSFDYWGQGTWSLGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033436 - protein, 299 aa, Homo sapiens
MAAPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPSTPPTPSPSTPPTPSPSCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033437 - protein, 304 aa, Homo sapiens
MVPLTLGPGTLGHRLLSIPDQPQGLPAEPPLTAPSQDGNVVIACLVQGFFPQEPLSVTWSESGQGVTARNFPPSQDASGDLYTTSSQLTLPATQCLADGKSVTCHVKHYTNPSQDVTVPCPVPPPPPCCHPRLSLHRPALEDLLLGSEANLTCTLTGLRDASGVTFTWDALKVGRALFKDHLRRDLCGCYSVSSVLPGCAEPWNHGKTFTCTAAYPEVQDPANRHPSQNPETHSGPEGPPAAAAVGGAGPERAGDAERAWHAASAPKDVLVRWLQGSQELPREKYLTWAFPAGAQPGHHPTLSL

SEQ ID NO: 1033438 - protein, 336 aa, Homo sapiens; identical to SEQ ID NO: 1033397

SEQ ID NO: 1033439 - protein, 237 aa, Homo sapiens
VSHQEFSKMKQSNNEANFKRRSLKNLATAYDNLLNCSYLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 1033440 - protein, 237 aa, Homo sapiens; identical to SEQ ID NO: 1033439

SEQ ID NO: 1033441 - protein, 237 aa, Homo sapiens; identical to SEQ ID NO: 1033439

SEQ ID NO: 1033442 - protein, 237 aa, Homo sapiens; identical to SEQ ID NO: 1033439

SEQ ID NO: 1033443 - protein, 172 aa, Homo sapiens
MLIFNTLSLIKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 1033444 - protein, 617 aa, Homo sapiens
EELCNKEEAKEVFENDPETDYFDPKYLVVFALFKLGYSLLQRQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 1033445 - protein, 617 aa, Homo sapiens; identical to SEQ ID NO: 1033444

SEQ ID NO: 1033446 - protein, 617 aa, Homo sapiens; identical to SEQ ID NO: 1033444

SEQ ID NO: 1033447 - protein, 617 aa, Homo sapiens; identical to SEQ ID NO: 1033444

SEQ ID NO: 1033448 - protein, 617 aa, Homo sapiens; identical to SEQ ID NO: 1033444

SEQ ID NO: 1033449 - protein, 617 aa, Homo sapiens; identical to SEQ ID NO: 1033444

SEQ ID NO: 1033450 - protein, 617 aa, Homo sapiens; identical to SEQ ID NO: 1033444

SEQ ID NO: 1033451 - protein, 86 aa, Homo sapiens
DPRKGARSVLSFWRGNLANVIRYFPTQALNFAFKDKYKQIFLVGRGQCTRSSGRYFCGQPPACRWPGKALEKGRIAIQPSAADSVS

SEQ ID NO: 1033452 - protein, 298 aa, Homo sapiens
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQFGRKGADIMYTGTVDCWRKIFRDEGGKAFFKGAWSNVLRGMGGAFVLVLYDELKKVI

SEQ ID NO: 1033453 - protein, 298 aa, Homo sapiens
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 1033454 - protein, 298 aa, Homo sapiens; identical to SEQ ID NO: 1033452

SEQ ID NO: 1033455 - protein, 298 aa, Homo sapiens; identical to SEQ ID NO: 1033453

SEQ ID NO: 1033456 - protein, 298 aa, Homo sapiens; identical to SEQ ID NO: 1033453

SEQ ID NO: 1033457 - protein, 298 aa, Homo sapiens; identical to SEQ ID NO: 1033453

SEQ ID NO: 1033458 - protein, 289 aa, Homo sapiens
RIGSGTEPRPRVKPPQASRGAPRVHAGSGRGLPTHDPGECLKGRSCPEAAAGLSQRRPPFTLRARSPAVLPFRCPPCHHDGTGHLLRQRLLGRRHSAAAISKTAVAPIERVKLLLQGPARQQADRRRQCSTMGIVDCIVLHPQGAGRACPSGGATLPTSFATSPLKPSTSPSRISTSRSSWRGVDNAHAVLGGTFAGNLGLRRFAGRRDLPLLRVPAWHFARTRLAADRGKRQGTEREFLRPGETAWVKDHQVPSGIPGALYQGFQVSPVPGAIHPSNPGRAYFPGVYE

SEQ ID NO: 1033459 - protein, 166 aa, Homo sapiens
MNNNTTPRRPERHHKRGHKTQRRTTRRTEKKTKQPPEPVETKKKRQKKRQHEKKTAKHTRTNKEQEPRRNDQHSAARGTPTRRQDKRTTRAAGTSGKDRRGGDEAERSRADRGTEPKNAEGEERGKRTKRGEEDGEGEAGGTKKEGAKGRGKKERQRRRRQGTAGS

SEQ ID NO: 1033460 - protein, 289 aa, Homo sapiens; identical to SEQ ID NO: 1033458

SEQ ID NO: 1033461 - protein, 289 aa, Homo sapiens; identical to SEQ ID NO: 1033458

SEQ ID NO: 1033462 - protein, 289 aa, Homo sapiens; identical to SEQ ID NO: 1033458

SEQ ID NO: 1033463 - protein, 289 aa, Homo sapiens; identical to SEQ ID NO: 1033458

SEQ ID NO: 1033464 - protein, 289 aa, Homo sapiens; identical to SEQ ID NO: 1033458

SEQ ID NO: 1033465 - protein, 289 aa, Homo sapiens; identical to SEQ ID NO: 1033458

SEQ ID NO: 1033466 - protein, 289 aa, Homo sapiens; identical to SEQ ID NO: 1033458

SEQ ID NO: 1033467 - protein, 289 aa, Homo sapiens; identical to SEQ ID NO: 1033458

SEQ ID NO: 1033468 - protein, 289 aa, Homo sapiens; identical to SEQ ID NO: 1033458

SEQ ID NO: 1033469 - protein, 258 aa, Homo sapiens
GTTKLRLGTRLGGESAEAAAGLSQRRPPFTLRARSPAVLPFRCPPCHHDGTGHLLRQRLLGRRHSAAAISKTAVAPIERVKLLLQGPARQQADRRRQCSTMGIVDCIVLHPQGAGRACPSGGATLPTSFATSPLKPSTSPSRISTSRSSWRGVDNAHAVLGGTFAGNLGLRRFAGRRDLPLLRVPAWHFARTRLAADRGKRQGTEREFLRPGETAWVKDHQVPSGIPGALYQGFQVSPVPGAIHPSNPGRAYFPGVYE

SEQ ID NO: 1033470 - protein, 289 aa, Homo sapiens; identical to SEQ ID NO: 1033458

SEQ ID NO: 1033471 - protein, 289 aa, Homo sapiens; identical to SEQ ID NO: 1033458

SEQ ID NO: 1033472 - protein, 289 aa, Homo sapiens; identical to SEQ ID NO: 1033458

SEQ ID NO: 1033473 - protein, 289 aa, Homo sapiens; identical to SEQ ID NO: 1033458

SEQ ID NO: 1033474 - protein, 289 aa, Homo sapiens; identical to SEQ ID NO: 1033458

SEQ ID NO: 1033475 - protein, 289 aa, Homo sapiens; identical to SEQ ID NO: 1033458

SEQ ID NO: 1033476 - protein, 289 aa, Homo sapiens; identical to SEQ ID NO: 1033458

SEQ ID NO: 1033477 - protein, 289 aa, Homo sapiens; identical to SEQ ID NO: 1033458

SEQ ID NO: 1033478 - protein, 289 aa, Homo sapiens; identical to SEQ ID NO: 1033458

SEQ ID NO: 1033479 - protein, 289 aa, Homo sapiens; identical to SEQ ID NO: 1033458

SEQ ID NO: 1033480 - protein, 289 aa, Homo sapiens; identical to SEQ ID NO: 1033458

SEQ ID NO: 1033481 - protein, 289 aa, Homo sapiens; identical to SEQ ID NO: 1033458

SEQ ID NO: 1033482 - protein, 289 aa, Homo sapiens; identical to SEQ ID NO: 1033458

SEQ ID NO: 1033483 - protein, 289 aa, Homo sapiens; identical to SEQ ID NO: 1033458

SEQ ID NO: 1033484 - protein, 289 aa, Homo sapiens; identical to SEQ ID NO: 1033458

SEQ ID NO: 1033485 - protein, 298 aa, Homo sapiens; identical to SEQ ID NO: 1033452

SEQ ID NO: 1033486 - protein, 298 aa, Homo sapiens; identical to SEQ ID NO: 1033452

SEQ ID NO: 1033487 - protein, 298 aa, Homo sapiens; identical to SEQ ID NO: 1033453

SEQ ID NO: 1033488 - protein, 298 aa, Homo sapiens; identical to SEQ ID NO: 1033452

SEQ ID NO: 1033489 - protein, 298 aa, Homo sapiens; identical to SEQ ID NO: 1033453

SEQ ID NO: 1033490 - protein, 298 aa, Homo sapiens; identical to SEQ ID NO: 1033452

SEQ ID NO: 1033491 - protein, 298 aa, Homo sapiens; identical to SEQ ID NO: 1033453

SEQ ID NO: 1033492 - protein, 289 aa, Homo sapiens; identical to SEQ ID NO: 1033458

SEQ ID NO: 1033493 - protein, 289 aa, Homo sapiens; identical to SEQ ID NO: 1033458

SEQ ID NO: 1033494 - protein, 289 aa, Homo sapiens; identical to SEQ ID NO: 1033458

SEQ ID NO: 1033495 - protein, 289 aa, Homo sapiens; identical to SEQ ID NO: 1033458

SEQ ID NO: 1033496 - protein, 289 aa, Homo sapiens; identical to SEQ ID NO: 1033458

SEQ ID NO: 1033497 - protein, 289 aa, Homo sapiens; identical to SEQ ID NO: 1033458

SEQ ID NO: 1033498 - protein, 289 aa, Homo sapiens; identical to SEQ ID NO: 1033458

SEQ ID NO: 1033499 - protein, 289 aa, Homo sapiens; identical to SEQ ID NO: 1033458

SEQ ID NO: 1033500 - protein, 502 aa, Homo sapiens; identical to SEQ ID NO: 771214

SEQ ID NO: 1033501 - protein, 401 aa, Homo sapiens
MSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 1033502 - protein, 461 aa, Homo sapiens
MASKKLGADFHQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 1033503 - protein, 502 aa, Homo sapiens; identical to SEQ ID NO: 771214

SEQ ID NO: 1033504 - protein, 502 aa, Homo sapiens; identical to SEQ ID NO: 771214

SEQ ID NO: 1033505 - protein, 224 aa, Homo sapiens
AETQETGSDGFNIRIVQKSTIQAPERKLYDIINTTGGHCYIHYHALNVLLFLKLPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 1033506 - protein, 502 aa, Homo sapiens; identical to SEQ ID NO: 771214

SEQ ID NO: 1033507 - protein, 245 aa, Homo sapiens
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLFSGNEKAYIECPLINPEGAIAYYERPLVKL

SEQ ID NO: 1033508 - protein, 502 aa, Homo sapiens; identical to SEQ ID NO: 771214

SEQ ID NO: 1033509 - protein, 502 aa, Homo sapiens; identical to SEQ ID NO: 771214

SEQ ID NO: 1033510 - protein, 460 aa, Homo sapiens
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEERAERH

SEQ ID NO: 1033511 - protein, 502 aa, Homo sapiens; identical to SEQ ID NO: 771214

SEQ ID NO: 1033512 - protein, 502 aa, Homo sapiens; identical to SEQ ID NO: 771214

SEQ ID NO: 1033513 - protein, 84 aa, Homo sapiens
PCGCSELRALMPPGRWGPCSLVPFPPPVCPAPVCGVCWAPRYSLQRRGASPDPFGPPPQVPSRPSRAPPGVPSQPIGSGKSIPS

SEQ ID NO: 1033514 - protein, 115 aa, Homo sapiens
MFVGGLSWDTSKKDLKDYFTKFGEVVDCTIKMDPNTGRSRGLGFILFKDAASVEKVLDQKEHRLDGRVIDPKKAMAMKKDPVKKSSWGSESEATEEKIREYFGELGRLRALNCWS

SEQ ID NO: 1033515 - protein, 102 aa, Homo sapiens
MFVGGLSWDTSKKDLKDYFTKFGEVVDCTIKMDPNTGRSRGLGFILFKDAASVEKVLDQKEHRLDGRVIDPKKAMAMKKDPAIHACAPPGLRTLLPHLLQST

SEQ ID NO: 1033516 - protein, 102 aa, Homo sapiens; identical to SEQ ID NO: 1033515

SEQ ID NO: 1033517 - protein, 164 aa, Homo sapiens
MSEAGEEQPMEKKGANEKGNEVPKGVGGWKGGGGGWRGEGGPRGNKGVEGDQIKERKKEEEEGKMLVGGLSWDTSKKDLKDYFTKFGEVVDCTIKMDPNTGRSRGLGFILFKDAASVEKVLDQKEHRLDGRVIDPKKAMAMKKDPVKKSSWGSESEATEEKIRE

SEQ ID NO: 1033518 - protein, 86 aa, Homo sapiens
QTSRGFPCIFEQDKPKPSGPSSVGFILFKDAASVEKVLDQKEHRLDGRVLLHMPWPFYGSMTRPSSLCSSWSKDLASTLASIDVTG

SEQ ID NO: 1033519 - protein, 81 aa, Homo sapiens
MDPNTGRSRGLGFILFKDAASVEKVLDQKEHRLDGRVIDPKKAMAMKKDPVKENLRWGSGILKPLEEKDQGEYFWAKLGEQ

SEQ ID NO: 1033520 - protein, 722 aa, Homo sapiens
QSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDINKLWIYITISNWILSQFNAWDVVALELFLKLTNKVDDCNYAIKRIRRPQLGELARDKVHAKKVKALAKLEHPGIVRYFNAWLEAPPEKWQEKMDEIWLKDESTDWPLSSPSPMDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKPQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 1033521 - protein, 296 aa, Homo sapiens
LLLVGLKAVSLLAQWLPICNRLVFGSSLLEATLSISPPRPTTLSLDLTKNTTEKPQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 1033522 - protein, 447 aa, Homo sapiens
QSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDINKLWIYITISNWILSQFNAWDVVALELFLKLTNKVDDCNYAIKRIRRPQLGELARDKVHAKKVKALAKLEHPGIVRYFNAWLEAPPEKWQEKMDEIWLKDESTDWPLSSPSPMDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTVLF

SEQ ID NO: 1033523 - protein, 631 aa, Homo sapiens
QSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDINKLWIYITISNWILSQFNAWDVVALELFLKLTNKVDDCNYAIKRIRRPQLGELARDKVHAKKVKALAKLEHPGIVRYFNAWLEAPPEKWQEKMDEIWLKDESTDWPLSSPSPMDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKPQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQVSFSDLYLLAQQQMYLMNLFSMFSLKYPVI

SEQ ID NO: 1033524 - protein, 427 aa, Homo sapiens
MDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKPQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 1033525 - protein, 722 aa, Homo sapiens; identical to SEQ ID NO: 1033520

SEQ ID NO: 1033526 - protein, 139 aa, Homo sapiens
MLFRTNTSTVTPVTVMVRSRDGSRSETPNTSSNWGWPGAAPRRGPADSWRRPAAPPGRRGTGRDPDTHAREDKSAGGPRRLGPRRLARSPRRAVVGGLSLTSRWLWVSPAPRAALHHEAGGALSRGVLPLLRCPSAPSA

SEQ ID NO: 1033527 - protein, 97 aa, Homo sapiens
PTTASSAGTDLVGKDEGHPGPVTGVLGDVANELQHGCDAWNTVSEQPAFSLSLKPTVPDLQQASYLPPAQVILFSLLSPKLKAGNSPSFWFSFLMQQ

SEQ ID NO: 1033528 - protein, 101 aa, Homo sapiens
DRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPDT

SEQ ID NO: 1033529 - protein, 139 aa, Homo sapiens; identical to SEQ ID NO: 1033526

SEQ ID NO: 1033530 - protein, 204 aa, Homo sapiens
DRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDPEQQSQNVTERRTPKTFTHNTSDQDYYQLNLMLQKNSVTQGEQIDGNSSELHLKNKYANTLRVHDARYGKAQPAERMTLRLTTQAERNEVLRGAIEN

SEQ ID NO: 1033531 - protein, 101 aa, Homo sapiens; identical to SEQ ID NO: 1033528

SEQ ID NO: 1033532 - protein, 101 aa, Homo sapiens; identical to SEQ ID NO: 1033528

SEQ ID NO: 1033533 - protein, 115 aa, Homo sapiens
DRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPETNRKTDDSRTTKQIC

SEQ ID NO: 1033534 - protein, 938 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 1033535 - protein, 940 aa, Homo sapiens
MRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 1033536 - protein, 959 aa, Homo sapiens
MRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREGAGAHRPTPTSRCMQW

SEQ ID NO: 1033537 - protein, 233 aa, Homo sapiens
TQGRAELMCELLTQGAVLPNSVAELLTQGRAANSGELHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 1033538 - protein, 131 aa, Homo sapiens
MRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSKQNMRPKK

SEQ ID NO: 1033539 - protein, 886 aa, Homo sapiens
MRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQAVPSH

SEQ ID NO: 1033540 - protein, 347 aa, Homo sapiens
TQGRAELMCELLTQGAVLPNSGAELLTQGRAANSGGGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 1033541 - protein, 885 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 1033542 - protein, 882 aa, Homo sapiens
MRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQEHRGWTRRFAKPKRHSAAATRY

SEQ ID NO: 1033543 - protein, 968 aa, Homo sapiens
MRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQVGQATLRGLGARALAGHGPPPSPEGRGHWDSGLWWGRELEIASQWPGAVAEWLPRARGTKPNEGHSMKVDSPLQKPGTEGKARHHET

SEQ ID NO: 1033544 - protein, 142 aa, Homo sapiens [sequence omitted]

SEQ ID NO: 1033545 - protein, 142 aa, Homo sapiens [sequence omitted]

SEQ ID NO: 1033546 - protein, 136 aa, Homo sapiens
APVLSCAQALIESGMKYEDAIQFIRQKRRGAINSKQLTYLEKYRPKKQRLRFKDPHTHKHMRFLITHNPTNATLSTFIEDLKKYGATTVVRVCEVTYDKTPLEKDGITVVDWPFDDRPRPDKVVNGREGILSSRPQ

SEQ ID NO: 1033547 - protein, 173 aa, Homo sapiens
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRAPVLVALALIESGMKYEDAIQFIRQKRRGRINSKQLTYLEKYRPKQRLRFKDPHTHKTRCCVM

SEQ ID NO: 1033548 - protein, 148 aa, Homo sapiens
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRKRRGAINSKQLTYLEKYRPKQRLRFKDPHTHKTRCCVM

SEQ ID NO: 1033549 - protein, 247 aa, Homo sapiens
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRAPRGRGPRESGKNEDATQTRKRFFFFFFFTFLKLKTDVGVDLNLYNDPGAAGARRLRGGRLGSVRTLAGPGGPAQPCSAQPSRGSRPWLAPHRLFLPDTSVHLCPRSEEPLGPWVASGPFLLSPPLPLAALAVALSL

SEQ ID NO: 1033550 - protein, 173 aa, Homo sapiens
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRAPVLVALALIESGMKYEDAIQFIRQKRRGAINSKQLTYLEKYRPKQRLRFKDPHTHKTRCCVM

SEQ ID NO: 1033551 - protein, 75 aa, Homo sapiens
APVLSCAQALIESGMKYEDAIQFIRQKRRGAINSKQLTYLEKYRPKKGCGSKTHTRTRPGAALCSSGPWLGLVVM

SEQ ID NO: 1033552 - protein, 155 aa, Homo sapiens
MARMNRPAPVEVSYKHMRFLITHNPTNATLSTFIEDLKKYGATTVVRVCEVTYDGAPPPGKVVEDWLSLVKAKFCEAPGSCVAVHCVAGLGRAPVLVALALIESGMKYEDAIQFIRQKRRGAINSKQLTYLEKYRPKQRLRFKDPHTHKTRCCVM

SEQ ID NO: 1033553 - protein, 173 aa, Homo sapiens; identical to SEQ ID NO: 1033550

SEQ ID NO: 1033554 - protein, 138 aa, Homo sapiens
MARMNRPAPVEVSYKHMRFLITHNPTNATLSTFIEDLKKYGATTVVRVCEVTYDKTPLEKDGITVVDWPFDDLRHSLWRRWPWLCLSEVGRAPSARPLPHQPGWSPLACLLWGGGIFCNHWAPSPSFATPCPDLFSAP

SEQ ID NO: 1033555 - protein, 148 aa, Homo sapiens; identical to SEQ ID NO: 1033548

SEQ ID NO: 1033556 - protein, 173 aa, Homo sapiens; identical to SEQ ID NO: 1033547

SEQ ID NO: 1033557 - protein, 173 aa, Homo sapiens; identical to SEQ ID NO: 1033547

SEQ ID NO: 1033558 - protein, 173 aa, Homo sapiens; identical to SEQ ID NO: 1033547

SEQ ID NO: 1033559 - protein, 173 aa, Homo sapiens; identical to SEQ ID NO: 1033547

SEQ ID NO: 1033560 - protein, 173 aa, Homo sapiens; identical to SEQ ID NO: 1033550

SEQ ID NO: 1033561 - protein, 419 aa, Homo sapiens
RGEAPYFYNDTVTFKCYSGFTLKDNSQIHCKADTTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 1033562 - protein, 98 aa, Homo sapiens
DAPAPRVAIQSVRCYSHGSQETDEEFDARWVTYFNKPDIDAWELRKGINTLVTYDMVPEPKIIDAALRACRRLNDFASTVRILEVVKDKAGPPSPRIY

SEQ ID NO: 1033563 - protein, 124 aa, Homo sapiens
DAPAPRVAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 1033564 - protein, 124 aa, Homo sapiens; identical to SEQ ID NO: 1033563

SEQ ID NO: 1033565 - protein, 124 aa, Homo sapiens; identical to SEQ ID NO: 1033563

SEQ ID NO: 1033566 - protein, 124 aa, Homo sapiens; identical to SEQ ID NO: 1033563

SEQ ID NO: 1033567 - protein, 98 aa, Homo sapiens
VIASPPEVEIRRSFKVGRKFLDDIGVDFLMVPEPKIIDAALRACRRLNDFASTVRILEVVKDKAGPHKEIYPYVIQELRPTLNELGISTPEELGLDKV

SEQ ID NO: 1033568 - protein, 124 aa, Homo sapiens; identical to SEQ ID NO: 1033563

SEQ ID NO: 1033569 - protein, 269 aa, Homo sapiens
GTRVFALNALHNIPHDNVEDLIRGGADVNCTHGTLKPLHCACMVSDADCVELLLEKGAEVNALDGYNRTALHYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 1033570 - protein, 300 aa, Homo sapiens
LDIDIILLEKETGTSTVSDKIVRVRTLCPLDSVLNSVLLGKPELNTLTEVVFCPQGADVNCTHGTLKPLHCACMVSDADCVELLLEKGAEVNALDGYNRTALHYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 1033571 - protein, 293 aa, Homo sapiens
MWYIMQSIQSKYSLSERLIRTIAAIRSFPHDNVEDLIRGGADVNCTHGTLKPLHCACMVSDADCVELLLEKGAEVNALWNWGFNKNPENKAPPLLTYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 1033572 - protein, 318 aa, Homo sapiens
MWYIMQSIQSKYSLSERLIRTIAAIRSFPHDNVEDLIRGSMVAIESGLLVQLFLPDDKVSSALIHKIVFSDVTGADVNCTHGTLKPLHCACMVSDADCVELLLEKGAEVNALDGYNRTALHYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 1033573 - protein, 318 aa, Homo sapiens; identical to SEQ ID NO: 1033572

SEQ ID NO: 1033574 - protein, 288 aa, Homo sapiens
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 1033575 - protein, 284 aa, Homo sapiens [sequence omitted]

SEQ ID NO: 1033576 - protein, 211 aa, Homo sapiens
MLTVWSYFWKKEPRYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 1033577 - protein, 129 aa, Homo sapiens
MKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 1033578 - protein, 293 aa, Homo sapiens
LHSTRMRGCPANAAAAPSAAEALLFDSLATVKLKSFRPEANEMGPPEGGSSRAEVAERRGEWRRKAGFGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTGGLSLGPGANVNFFFYRDYKRTTR

SEQ ID NO: 1033579 - protein, 176 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPGVAGVPAAAVRSPGHRCLRRGGGRGVPEAAGAEQALLLSGASGGACPWAQEPM

SEQ ID NO: 1033580 - protein, 331 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033581 - protein, 356 aa, Homo sapiens
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 1033582 - protein, 331 aa, Homo sapiens; identical to SEQ ID NO: 1033580

SEQ ID NO: 1033583 - protein, 327 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVCCSS

SEQ ID NO: 1033584 - protein, 323 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGACPWAQEPM

SEQ ID NO: 1033585 - protein, 188 aa, Homo sapiens
ATAITGVSYCAWPNVNQFLSVQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033586 - protein, 323 aa, Homo sapiens; identical to SEQ ID NO: 1033584

SEQ ID NO: 1033587 - protein, 305 aa, Homo sapiens
AEETVQCGVGGAQSGREAEWQKQGPARPQLLHPQPGELGKVSVFSPPVQGSVPVGPIPGWAGPVGTLCGGERLWAGVECGTQVLGDPPGGLPRASSCGLGEPVTRAALLQKGPSDHSVGVGLGYVDSWASPYPELDSEEPRSLVLTGFLQQKAAQACRWGPGSLWAWSSLCPTLPWGLQSWLGWASPDLCPSPVRGVSTTGLPTVAGCPVPSPLPSCSPLIPVPCCRFSSPVSSPPDNVDDPTGNFRSGPPDGVAGVPAAAVRSPGHRCLRRGGGRGVPEAAGAEQALLLSGASGGACPWAQEPM

SEQ ID NO: 1033588 - protein, 303 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCGPCRQLLNTGGSPGPHWGGLLRTWGSDFVLWCVARVATDKA

SEQ ID NO: 1033589 - protein, 219 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVSTDWAVAPAGSC

SEQ ID NO: 1033590 - protein, 326 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTAWGQNRGDWFGSGWPSPVYFGPRPDRFVWSSRVSFCAP

SEQ ID NO: 1033591 - protein, 91 aa, Homo sapiens
QGPAQKSRAPTLTTKFAAASNILLLAQQGQVAEPRLRVWHPPQLETEALLGLVSQEQGSVSTDGLWPLQAAVEHWRVPRTTLGWAPEDVGK

SEQ ID NO: 1033592 - protein, 125 aa, Homo sapiens
SAPYTSQTGQTYGEDRCVTGRSCRLCWKQDNFHGLAIFLDTYPNDETTERVFPYISVMVNNGSLSYDHSKDGRWTELAGCTADFRNRDHDTFLAVRYSRGRLTVMTDPEGQETSGKKLALTITGE

SEQ ID NO: 1033593 - protein, 331 aa, Homo sapiens; identical to SEQ ID NO: 1033580

SEQ ID NO: 1033594 - protein, 331 aa, Homo sapiens; identical to SEQ ID NO: 1033580

SEQ ID NO: 1033595 - protein, 312 aa, Homo sapiens
LHSTRMRGCPANAAAAPSAAEALLFDSLATVKLKSFRPEANEMGPPEGGSSRAEVAERRGEWRRKAGFGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033596 - protein, 298 aa, Homo sapiens
LHSTRMRGCPANAAAAPSAAEALLFDSLATVKLKSFRPEANRWDPRKAEVQGGSGREERRMAAEGWIWVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033597 - protein, 337 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGIVVCAVVGAVVFQKRQERNKRFY

SEQ ID NO: 1033598 - protein, 190 aa, Homo sapiens
MLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033599 - protein, 229 aa, Homo sapiens
LHSTRMRGCPANAAAAPSAAEALLFDSLATVKLKSFRPEANEMGPPEGGSSRAEVAERRGEWRRKAGFGVGAGAGGAWEGLGFSAPALAPLHLSFFFCCWGLGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033600 - protein, 111 aa, Homo sapiens
ATITEMYREHALSGLIIGVEVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033601 - protein, 269 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVIGVPEAAGAEQALLLSGASGGACPWAQEPM

SEQ ID NO: 1033602 - protein, 257 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDLTIMTSSP

SEQ ID NO: 1033603 - protein, 269 aa, Homo sapiens; identical to SEQ ID NO: 1033601

SEQ ID NO: 1033604 - protein, 144 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSLVFQKRQERNKRFY

SEQ ID NO: 1033605 - protein, 356 aa, Homo sapiens; identical to SEQ ID NO: 1033581

SEQ ID NO: 1033606 - protein, 315 aa, Homo sapiens
KIASDQCSLYFVTGEVVENSWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFYYFGARGGRRHVDNHDSSPEVSSEGAHSRERLVANWPRQSQGQKGGP

SEQ ID NO: 1033607 - protein, 186 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHRDGVLLLLPRLVLNSLAQANLP

SEQ ID NO: 1033608 - protein, 356 aa, Homo sapiens; identical to SEQ ID NO: 1033581

SEQ ID NO: 1033609 - protein, 286 aa, Homo sapiens
KIASDQCSLYFVTGEVVENSWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033610 - protein, 239 aa, Homo sapiens
DAWVDPRVPVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033611 - protein, 321 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033612 - protein, 324 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDPVLTIMTSSP

SEQ ID NO: 1033613 - protein, 312 aa, Homo sapiens
LHSTRMRGCPANAAAAPSAAEALLFDSLATVKLKSFRPEANRWDPRKAEVQGGSGREERRMAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTGGLSLGPGANVNFFFYRDYKRTTR

SEQ ID NO: 1033614 - protein, 303 aa, Homo sapiens; identical to SEQ ID NO: 1033588

SEQ ID NO: 1033615 - protein, 277 aa, Homo sapiens
LIYSFFWAFNIINVSLSGGTNEEILESIRAKKGDIDNVKSPTGEETEKDKNETENDSKDAEKNREEFEDQSLEKDSDDKTPDDDPEQGKSEEEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINIILNGQEGKYRVYHNQYFTNSLLSITSTEKTI

SEQ ID NO: 1033616 - protein, 341 aa, Homo sapiens
FNLQFLLGLFNIINVSLSGGTNEEILESIRAKKGDIDNVKSPTGEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKWVKKGSIASTTINTSPIHCFEYTSTEKTI

SEQ ID NO: 1033617 - protein, 277 aa, Homo sapiens
LIYSFFWAFNIINVSLSGGTNEEILESIRAKKGDIDNVKSPTGEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPVGDFKSEKSNGELSESPGAGKGASGSTRIITRLRNPDSKLSQLKSQQVAAAAHEANKLFKEGKEVLVVNSQGEISRLSTKKEVIMKGNINNYFKWVKKGSIASTTINTSPIHCFEYTSTEKTI

SEQ ID NO: 1033618 - protein, 177 aa, Homo sapiens
PPKKVFVGGLSPDTSEEQIKEYFGAFGEIENIELPMDTKTNERRGFCFITYTDEEPVKKLLESRYHQIGSGKCEIKVHNPKRYIGSNSNNKKVEEVLQLVDEVVRGVVAEVRAKTGTKDLITIMIKDMEITIVPMVVIKTIVAMADMIILGITMGTMDMDRDMQTTVANRALMARHL

SEQ ID NO: 1033619 - protein, 240 aa, Homo sapiens
MFCHLRPMRRLCLEKIFPHWFPFSRALSGAEAVNALRPFYFAVHPDFFGQHPVEREINENSLKRLSVYLENLQKPGFKSLKPTQLTFYVRETDQSSSDGQEPFSTSGFRAVKFTLHTRDLLSTVLYILNSCSLSVEHIQSLNTNMHTQPLKEAKRMPDRPIKWDKSYYSFTGFKDPDEDLEQVSRVETTLTSWLDNNGKSAVKKLKNSLPLRKELDCLKDELSSTIATLRYQVAKELGHR

SEQ ID NO: 1033620 - protein, 115 aa, Homo sapiens
MFCHLRPMRRLCLEKIFPHWFPFSRALSGAEAVNALRPFYFAVHPDFFGQHPVEREINENSLKRLSVYLENLQKPGFKSLKPTQLTFYVRETDQSSSDGQEPFSTSVYLLNISKA

SEQ ID NO: 1033621 - protein, 150 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIASFSSHIIGMGIPAQVHTRKPRQAQRSFPFNIQETNGSQLHRQPAISGTLACMRSQAHNVFNNSAAT

SEQ ID NO: 1033622 - protein, 127 aa, Homo sapiens; identical to SEQ ID NO: 772424

SEQ ID NO: 1033623 - protein, 127 aa, Homo sapiens; identical to SEQ ID NO: 772424

SEQ ID NO: 1033624 - protein, 127 aa, Homo sapiens; identical to SEQ ID NO: 772424

SEQ ID NO: 1033625 - protein, 129 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKVNSGQCGCNEIQYLGQYSDPSMTSVALV

SEQ ID NO: 1033626 - protein, 386 aa, Homo sapiens
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQCLTGKAPFQASSPQDLRLFYEKNKTLVPTIPRETSAPLRQLLLALLQRNHKDRMDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSG

SEQ ID NO: 1033627 - protein, 784 aa, Homo sapiens
MDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSGSSLVASAGLESHGRTPSPSPPCSSSPSPSGRAGPFSSSRCGASVPIPVPTQVQNYQRIERNLQSPTQFQTPRSSAIRRSGSTSPLGFARASPSPPAHAEHGGVLARKMSLGGGRPYTPSPQVGTIPERPGWSGTPSPQGAEMRGGRSPRPGSSAPEHSPRTSGLGCRLHSAPNLSDLHVVRPKLPKPPTDPLGAVFSPPQASPPQPSHGLQSCRNLRGSPKLPDFLQRNPLPPILGSPTKAVPSFDFPKTPSSQNLLALLARQGVVMTPPRNRTLPDLSEVGPFHGQPLGPGLRPGEDPKGPFGRSFSTSRLTDLLLKAAFGTQAPDPGSTESLQEKPMEIAPSAGFGGSLHPGARAGGTSSPSPVVFTVGSPPSGSTPPQGPRTRMFSAGPTGSASSSARHLVPGPCSEAPAPELPAPGHGCSFADPIAANLEGAVTFEAPDLPEETLMEQEHTEILRGLRFTLLFVQHVLEIAALKGSASEAAGGPEYQLQESVVADQISLLSREWGFAEQLVLYLKVAELLSSGLQSAIDQIRAGKLCLSSTVKQVVRRLNELYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 1033628 - protein, 124 aa, Homo sapiens
QAVPPPRGISSTHAARYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 1033629 - protein, 105 aa, Homo sapiens
MQTHARAPQARAPDHVAAQVWTSAGELAPGGVGPCARGRGSSLFKRSSGDRQQRHRVLSALDTSCNLSHFIPKTCLIFMQLIFSLKEKTCRCLRIGFGRARTGPG

SEQ ID NO: 1033630 - protein, 230 aa, Homo sapiens
LKPVEGEGSVRETPRVPSPQPSRALTLGDVLDVGLVREHVLQPLQEQQGLVERGTQPLTVLEHLVQGSRLHHLHSVAEDEPLGSDAVNAVQEPLLVQEEALQPQAQPRRTGKGLRPLPTQSQSELLLRAGQQALCPGRACGLGVPQSPGASPSEIPTQLCQSPKHFMHIETEPGPHQGLLGSDSWQWPGVCTYTYADTCQGPPSPSTGPRCCPGLDLSGRTGSGGSGALR

SEQ ID NO: 1033631 - protein, 257 aa, Homo sapiens
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQSAGGSGGAMDPCGGFQGHTPHNRQKYTHVCFSLQYLKYCHCAWT

SEQ ID NO: 1033632 - protein, 376 aa, Homo sapiens
AVRSIVICCGSETMALAVFSTSRLTDLLLKAAFGTQAPDPGSTESLQEKPMEIAPSAGFGGSLHPGARAGGTSSPSPVVFTVGSPPSGSTPPQGPRTRMFSAGPTGSASSSARHLVPGPCSEAPAPELPAPGHGCSFADPIAANLEGAVTFEAPDLPEETLMEQEHTEILRGLRFTLLFVQHVLEIAALKGSASEAAGGPEYQLQESVVADQISLLSREWGFAEQLVLYLKVAELLSSGLQSAIDQIRAGKLCLSSTVKQVVRRLNELYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 1033633 - protein, 586 aa, Homo sapiens
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQCLTGKAPFQASSPQDLRLFYEKNKTLVPTIPRETSAPLRQLLLALLQRNHKDRMDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSGSSLVASAGLESHGRTPSPSPPCSSSPSPSGRAGPFSSSRCGASVPIPVPTQVQNYQRIERNLQSPTQFQTPRSSAIRRSGSTSPLGFARASPSPPAHAEHGGVLARKMSLGGGRPYTPSPQVGTIPERPGWSGTPSPQGAEMRGGRSPRPGSSAPEHSPRTSGLGCRLHSAPNLSDIENVTKCKLCIERRLSALLTGICA

SEQ ID NO: 1033634 - protein, 78 aa, Homo sapiens
PYLGLEADEGRVLGTHLSCCCHREGRQGTATNTGVPSTLPTWAWKQMRGILHAKKKVTCAKAPRPALTVSFDVSSSAG

SEQ ID NO: 1033635 - protein, 1050 aa, Homo sapiens
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQCLTGKAPFQASSPQDLRLFYEKNKTLVPTIPRETSAPLRQLLLALLQRNHKDRMDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSGSSLVASAGLESHGRTPSPSPPCSSSPSPSGRAGPFSSSRCGASVPIPVPTQVQNYQRIERNLQSPTQFQTPRSSAIRRSGSTSPLGFARASPSPPAHAEHGGVLARKMSLGGGRPYTPSPQVGTIPERPGWSGTPSPQGAEMRGGRSPRPGSSAPEHSPRTSGLGCRLHSAPNLSDLHVVRPKLPKPPTDPLGAVFSPPQASPPQPSHGLQSCRNLRGSPKLPDFLQRNPLPPILGSPTKAVPSFDFPKTPSSQNLLALLARQGVVMTPPRNRTLPDLSEVGPFHGQPLGPGLRPGEDPKGPFGRSFSTSRLTDLLLKAAFGTQAPDPGSTESLQEKPMEIAPSAGFGGSLHPGARAGGTSSPSPVVFTVGSPPSGSTPPQGPRTRMFSAGPTGSASSSARHLVPGPCSEAPAPELPAPGHGCSFADPIAANLEGAVTFEAPDLPEETLMEQEHTEILRGLRFTLLFVQHVLEIAALKGSASEAAGGPEYQLQESVVADQISLLSREWGFAEQLVLYLKVAELLSSGLQSAIDQIRAGKLCLSSTVKQVVRRLNELYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 1033636 - protein, 406 aa, Homo sapiens
SGGLAGGAGPRRRRQVAWGTGRRGWERVGGREAGAARPQDLELRLRLPAALPAMRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 1033637 - protein, 386 aa, Homo sapiens
SGGLAGGAGPRRRRQVAWGTGRRGWERVGGREAGAARPQDLELRLRLPAALPAMRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSQDRPLRFLPALLSVSWMLAWRGPRMDPWPEHAHPARLQLQSMDSCLLSACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 1033638 - protein, 237 aa, Homo sapiens
EKTQILAAPVPCACRGLTGTGALCMSGSDAGSLLQSVTPAVWAAQGKAQETVKSVSLATRGSTDSVQVSDGAVLDAGGPFPSDHDVNGPSRYCQGWEAVETRPADVAPPGSLCTRPEVHVDTEAVGVGDGLCMADPGVDGAAAPASRRWPRSPGPPPLLSLQLLGGDCPEAEGQACMVVGCLGEPWAWMEPGGESGFPGQVRWLTPVNPALWEAERGGSRGQEIETILANTVKPHLY

SEQ ID NO: 1033639 - protein, 455 aa, Homo sapiens
SGGLAGGAGPRRRRQVAWGTGRRGWERVGGREAGAARPQDLELRLRLPAALPAMRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTVRTGLSDSYPPCCLSLGCWRGVGHAWIRGRNTHTQPGYSSRVWIAAFSPACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 1033640 - protein, 321 aa, Homo sapiens
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEDVDECSLAEKTCVRKNENCYNTPGSYVCVCPDGFEETEDACVPPAEAEATEGESPTQLPSREDL

SEQ ID NO: 1033641 - protein, 775 aa, Homo sapiens
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 1033642 - protein, 378 aa, Homo sapiens
MNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKGGARARI

SEQ ID NO: 1033643 - protein, 378 aa, Homo sapiens; identical to SEQ ID NO: 1033642

SEQ ID NO: 1033644 - protein, 378 aa, Homo sapiens; identical to SEQ ID NO: 1033642

SEQ ID NO: 1033645 - protein, 378 aa, Homo sapiens; identical to SEQ ID NO: 1033642

SEQ ID NO: 1033646 - protein, 378 aa, Homo sapiens; identical to SEQ ID NO: 1033642

SEQ ID NO: 1033647 - protein, 612 aa, Homo sapiens
MIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 1033648 - protein, 306 aa, Homo sapiens
MNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPQRQCV

SEQ ID NO: 1033649 - protein, 612 aa, Homo sapiens; identical to SEQ ID NO: 1033647

SEQ ID NO: 1033650 - protein, 407 aa, Homo sapiens
AENSQSKTTPVSSSCLRDEHLPSRSVANISKSPAACQHPFKFPVPRRRKQSPRKGRFVRPVLFKGDRRPWSAPPPPAKEGPHWLSPEASLSLVSEWMPTCRLGPKFLLVSGVSAMAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPTHHESTKAAPGDYWWAGTYPVPARTQWNPAYWTCQSYSLGVTAFDV

SEQ ID NO: 1033651 - protein, 378 aa, Homo sapiens; identical to SEQ ID NO: 1033642

SEQ ID NO: 1033652 - protein, 378 aa, Homo sapiens; identical to SEQ ID NO: 1033642

SEQ ID NO: 1033653 - protein, 378 aa, Homo sapiens; identical to SEQ ID NO: 1033642

SEQ ID NO: 1033654 - protein, 378 aa, Homo sapiens; identical to SEQ ID NO: 1033642

SEQ ID NO: 1033655 - protein, 378 aa, Homo sapiens; identical to SEQ ID NO: 1033642

SEQ ID NO: 1033656 - protein, 405 aa, Homo sapiens
MNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEVNCGGGGSRLLLSLVLGTFHLLISVSPSTSCFR

SEQ ID NO: 1033657 - protein, 416 aa, Homo sapiens
AENSQSKTTPVSSSCLRDEHLPSRSVANISKSPAACQHPFKFPVPRRRKQSPRKGRFVRPVLFKGDRRPWSAPPPPAKEGPHWLSPEASLSLVSEWMPTCRLGPKFLLVSGVSAMAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPTHHESTKAAPGDYWWAGTYPVPARTQWNPAYWTCQSHQFQLWLCQGQQWHLFSAF

SEQ ID NO: 1033658 - protein, 346 aa, Homo sapiens
MWEFTDGATFQANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKGGARARI

SEQ ID NO: 1033659 - protein, 287 aa, Homo sapiens
AENSQSKTTPVSSSCLRDEHLPSRSVANISKSPAACQHPFKFPVPRRRKQSPRKGRFVRPVLFKGDRRPWSAPPPPAKEGPHWLSPEASLSLVSEWMPTCRLGPKFLLVSGVSAMAALDSLSLFTSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKGGARARI

SEQ ID NO: 1033660 - protein, 775 aa, Homo sapiens; identical to SEQ ID NO: 1033641

SEQ ID NO: 1033661 - protein, 612 aa, Homo sapiens; identical to SEQ ID NO: 1033647

SEQ ID NO: 1033662 - protein, 612 aa, Homo sapiens; identical to SEQ ID NO: 1033647

SEQ ID NO: 1033663 - protein, 612 aa, Homo sapiens; identical to SEQ ID NO: 1033647

SEQ ID NO: 1033664 - protein, 137 aa, Homo sapiens
RLGTRYFLWQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 1033665 - protein, 775 aa, Homo sapiens; identical to SEQ ID NO: 1033641

SEQ ID NO: 1033666 - protein, 378 aa, Homo sapiens; identical to SEQ ID NO: 1033642

SEQ ID NO: 1033667 - protein, 405 aa, Homo sapiens; identical to SEQ ID NO: 1033656

SEQ ID NO: 1033668 - protein, 612 aa, Homo sapiens; identical to SEQ ID NO: 1033647

SEQ ID NO: 1033669 - protein, 352 aa, Homo sapiens
MNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLLCAGRAEMNNPTAMGGWRTTGDITNFLPPRLGIQGPTSNLNRSIRSLA

SEQ ID NO: 1033670 - protein, 612 aa, Homo sapiens; identical to SEQ ID NO: 1033647

SEQ ID NO: 1033671 - protein, 416 aa, Homo sapiens; identical to SEQ ID NO: 1033657

SEQ ID NO: 1033672 - protein, 435 aa, Homo sapiens
AFLVLPGVVSRAPVAACWEETGARLGRMELATRYQIPKEVADIFNAPSDDEEFVGFRDDVPMETLSSEESCDSFDSLESGKQVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 1033673 - protein, 99 aa, Homo sapiens
KHPFILRRRTKTGGGLFLIRGATPCGPCLRNRYGEDVRSALLDPDWVCPPCRGICNCSYCRKRDGRCATGILIHLAKFYGYDNVKEYLESLQKELVEDN

SEQ ID NO: 1033674 - protein, 481 aa, Homo sapiens
AFLVLPGVVSRAPVAACWEETGARLGRMELATRYQIPKEVADIFNAPSDDEEFVGFRDDVPMETLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 1033675 - protein, 472 aa, Homo sapiens
AFLVLPGVVSRAPVAACWEETGARLGRMELATRYQIPKEVADIFNAPSDDEEFVGFRDDVPMETLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLES

SEQ ID NO: 1033676 - protein, 143 aa, Homo sapiens
MRHAEKNTHPANGKNNTNREKTIREKHPNNQGGGRQIVRHNTPRKKSKLLMRGDTYTHCSRGLHRWVHNNSKDYHAEGERKEIFTSEGVYLSQYPRRDDRQTIDTKPSTQQSDATGTKNTGARSGHRTTKTQMKRHDSKHTRL

SEQ ID NO: 1033677 - protein, 115 aa, Homo sapiens
MRRERRGDVAVLQSDCLPLQAQPSAMACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 1033678 - protein, 46 aa, Homo sapiens
MACPLDQAIGLLVAIFHKYSGREGDKNTVYNTYHSQTVSKSCVPSL

SEQ ID NO: 1033679 - protein, 199 aa, Homo sapiens
HWISGSGETRHQACSGHCWAPPSRPNPEQPRAGGVESRGGNPANVLLCKPLCTGVGCGLGLGLGGVGLAELASGAPTAIRPVGLRHSPSPRPLASHLAASLPLQAQPSAMACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 1033680 - protein, 60 aa, Homo sapiens
MACPLDQAIGLLVAIFHKYSGREGDKHTLSKKEIHMVQADTALVGHVQEVLRVHLIQQSD

SEQ ID NO: 1033681 - protein, 199 aa, Homo sapiens; identical to SEQ ID NO: 1033679

SEQ ID NO: 1033682 - protein, 119 aa, Homo sapiens [sequence omitted]

SEQ ID NO: 1033683 - protein, 73 aa, Homo sapiens
MAFKDTGKTPVEPEVAIHRIRITLTSRNVKSLEKLRVELDKLTTWYENLSIHRPAVSGKRLQDLCSRQELRRG

SEQ ID NO: 1033684 - protein, 119 aa, Homo sapiens [sequence omitted]

SEQ ID NO: 1033685 - protein, 146 aa, Homo sapiens
MAFKDTGKTPVEPEVAIHRIRITLTSRNVKSLEKVCADLIRGAKEKNLKVKGPVRMPTKTLRITTRKTPCGEGSKTWDRFQMRIHKRLIDLHSPSEIVKQITSISIEPGVESLSLSPRLDVHWRDLSSLQPLPTWVQVILVSQPPE

SEQ ID NO: 1033686 - protein, 112 aa, Homo sapiens
MLSQPRISYDAQFEVIKGQTIEVRCESISGTLPISYQLLKTSKVLENSTKNSNDPAVFKDNPTEDVEYQCVADNCHSHAKMLSEVLRVKVIGKLLCCEKKSCGLGAFFHAQG

SEQ ID NO: 1033687 - protein, 728 aa, Homo sapiens [sequence omitted]

SEQ ID NO: 1033688 - protein, 256 aa, Homo sapiens
MWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 1033689 - protein, 191 aa, Homo sapiens [sequence omitted]

SEQ ID NO: 1033690 - protein, 728 aa, Homo sapiens [sequence omitted]

SEQ ID NO: 1033691 - protein, 280 aa, Homo sapiens
MWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVY

SEQ ID NO: 1033692 - protein, 309 aa, Homo sapiens
TREPEPGDLLEPRRHTFRKPEIIPLHSSLGDKSGTLSQRKKKKVEQCLSHVPLPLPFFAQCESFSCFSAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 1033693 - protein, 728 aa, Homo sapiens [sequence omitted]

SEQ ID NO: 1033694 - protein, 252 aa, Homo sapiens [sequence omitted]

SEQ ID NO: 1033695 - protein, 25 aa, Homo sapiens [sequence omitted]

SEQ ID NO: 1033696 - protein, 25 aa, Homo sapiens [sequence omitted]

SEQ ID NO: 1033697 - protein, 65 aa, Homo sapiens
LRWADCTIQSSDDSRHLASSQQTNCSLSLFPCRNLCAMRAKWRKKRMRKAEAQKKKDEAEVQVNR

SEQ ID NO: 1033698 - protein, 102 aa, Homo sapiens
FFSTGQKEPLLLFMIATYAFSGAETWNARRWGCWYKLWDCMLLSRACLNGSRTSSPSDRRSPLRPTLLINKMPMLVLCPGTCDILDYFCVYLWPSVTRGSLE

SEQ ID NO: 1033699 - protein, 25 aa, Homo sapiens [sequence omitted]

SEQ ID NO: 1033700 - protein, 25 aa, Homo sapiens [sequence omitted]

SEQ ID NO: 1033701 - protein, 25 aa, Homo sapiens [sequence omitted]

SEQ ID NO: 1033702 - protein, 25 aa, Homo sapiens [sequence omitted]

SEQ ID NO: 1033703 - protein, 25 aa, Homo sapiens [sequence omitted]

SEQ ID NO: 1033704 - protein, 25 aa, Homo sapiens [sequence omitted]

SEQ ID NO: 1033705 - protein, 25 aa, Homo sapiens [sequence omitted]

SEQ ID NO: 1033706 - protein, 25 aa, Homo sapiens [sequence omitted]

SEQ ID NO: 1033707 - protein, 25 aa, Homo sapiens [sequence omitted]

SEQ ID NO: 1033708 - protein, 43 aa, Homo sapiens
MLLSRACLNGSRTSSPSDRRSPLRPTTCTDEPPKEPPKEPPDE

SEQ ID NO: 1033709 - protein, 65 aa, Homo sapiens; identical to SEQ ID NO: 1033697

SEQ ID NO: 1033710 - protein, 65 aa, Homo sapiens; identical to SEQ ID NO: 1033697

SEQ ID NO: 1033711 - protein, 44 aa, Homo sapiens
MLLSRACLNGSRTSSPSDRRSPLRPTHKEPRKGHTKGHTMRHTR

SEQ ID NO: 1033712 - protein, 54 aa, Homo sapiens
MPDAGDAGTSCGTACYCLELVSMDLVPHAPKEPSQCATQAPHHEPHEEPPSGDP

SEQ ID NO: 1033713 - protein, 25 aa, Homo sapiens [sequence omitted]

SEQ ID NO: 1033714 - protein, 25 aa, Homo sapiens [sequence omitted]

SEQ ID NO: 1033715 - protein, 25 aa, Homo sapiens [sequence omitted]

SEQ ID NO: 1033716 - protein, 25 aa, Homo sapiens [sequence omitted]

SEQ ID NO: 1033717 - protein, 25 aa, Homo sapiens [sequence omitted]

SEQ ID NO: 1033718 - protein, 25 aa, Homo sapiens [sequence omitted]

SEQ ID NO: 1033719 - protein, 25 aa, Homo sapiens [sequence omitted]

SEQ ID NO: 1033720 - protein, 25 aa, Homo sapiens [sequence omitted]

SEQ ID NO: 1033721 - protein, 25 aa, Homo sapiens [sequence omitted]

SEQ ID NO: 1033722 - protein, 25 aa, Homo sapiens [sequence omitted]

SEQ ID NO: 1033723 - protein, 25 aa, Homo sapiens [sequence omitted]

SEQ ID NO: 1033724 - protein, 25 aa, Homo sapiens [sequence omitted]

SEQ ID NO: 1033725 - protein, 25 aa, Homo sapiens [sequence omitted]

SEQ ID NO: 1033726 - protein, 65 aa, Homo sapiens; identical to SEQ ID NO: 1033697

SEQ ID NO: 1033727 - protein, 25 aa, Homo sapiens [sequence omitted]

SEQ ID NO: 1033728 - protein, 64 aa, Homo sapiens
MLLSRACLNGSRTSSPSDRRSPLRPTLLINKMPMLVLCPGTCDILDYFCVYSWHYVQHWHNVHT

SEQ ID NO: 1033729 - protein, 25 aa, Homo sapiens [sequence omitted]

SEQ ID NO: 1033730 - protein, 95 aa, Homo sapiens
WNDTEKISMAPRRMTRKFVKRPYFEARGRPKPLLLLPITSATTAMGLTISSLFSRLFGKKQMRILMVGLDAAGKTTILYKLKLGEIVTTIPTMWF

SEQ ID NO: 1033731 - protein, 110 aa, Homo sapiens
GEPELPSKSPSRSSTGLFLCRIFIGTGATETFLPPSFFLRSFSSLSFSLPGSLKGESTGSPQTPSASAHHKCHYRHGPHYLLPLLPTIWQEADAHFDGWIGCCWQDNHSV

SEQ ID NO: 1033732 - protein, 118 aa, Homo sapiens
GEPELPSKSPSRSSTGLFLCRIFIGTGATETFLPPSFFLRSFSSLSFSLPGSLKGESTGSPQTPSASAHHKCHYRHGPHYLLPLLPTIWQEADAHFDGGSYFFVVDSNDREQNSGSSR

SEQ ID NO: 1033733 - protein, 116 aa, Homo sapiens
AGGINAECPLRPGQSPSRSSTGLFLCRIFIGTGATETFLPPSFFLRSFSSLSFSLPGSLKGESTGSPQTPSASAHHKCHYRHGPHYLLPLLPTIWQEADAHFDGWIGCCWQDNHSV

SEQ ID NO: 1033734 - protein, 631 aa, Homo sapiens
MDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPRRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 1033735 - protein, 785 aa, Homo sapiens
AQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVPGKWVPNFRENDCHQEKKPPVQGNHSCWRLLGRTC

SEQ ID NO: 1033736 - protein, 553 aa, Homo sapiens
AQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKVGFLCKHLQ

SEQ ID NO: 1033737 - protein, 209 aa, Homo sapiens
MDWTCVISGPDFLWFAQVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 1033738 - protein, 197 aa, Homo sapiens [sequence omitted]

SEQ ID NO: 1033739 - protein, 631 aa, Homo sapiens; identical to SEQ ID NO: 1033734

SEQ ID NO: 1033740 - protein, 631 aa, Homo sapiens; identical to SEQ ID NO: 1033734

SEQ ID NO: 1033741 - protein, 631 aa, Homo sapiens; identical to SEQ ID NO: 1033734

SEQ ID NO: 1033742 - protein, 233 aa, Homo sapiens
MYVFPLQQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 1033743 - protein, 217 aa, Homo sapiens
MAPAASRLRAEAGLGALPRRALAQYLLFLRLYPVLTKAATSGILSALGNFLAQMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKVRATGLSLCQHYFVSLFLPSFLPLSSPPPSPLLFSSLLSFVVFR

SEQ ID NO: 1033744 - protein, 195 aa, Homo sapiens
MAPAASRLRAEAGLGALPRRALAQYLLFLRLYPVLTKAATSGILSALGNFLAQMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKFRVLFANLAALFWYAYLASLGK

SEQ ID NO: 1033745 - protein, 195 aa, Homo sapiens; identical to SEQ ID NO: 1033744

SEQ ID NO: 1033746 - protein, 217 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 1033747 - protein, 217 aa, Homo sapiens; identical to SEQ ID NO: 1033746

SEQ ID NO: 1033748 - protein, 218 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVDGQRVCF

SEQ ID NO: 1033749 - protein, 215 aa, Homo sapiens
RSVRTSDVSPTPVWFAVCCLVQAGAVQRSLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 1033750 - protein, 198 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYEAALPASRESCK

SEQ ID NO: 1033751 - protein, 303 aa, Homo sapiens
MAPGSRTSLLLAFALLCLPWLQEGSAFPTIPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMWVRVAPGVPNPGAPLASRDWGTETLLPSSYHSGADPKELTLFFISPGESSRPFSTPWRGGKENGSMREGGNSPQALGPSLSSFIFAGRLEDGSRRTGQILKQTYSKFDTNSHNHDALLKNYGLLYCFRKDMDKVETFLRMVQCRSVEGSCGF

SEQ ID NO: 1033752 - protein, 211 aa, Homo sapiens
MIPVRAFSGIKSEQAAVQSVPVSPELMTHRSFCQSHCAHHLAIYTYPDFAHDDLAAYRNYTFLLESRIAIVLLTLHIPTPVASMEDLQHKSDLVLLWIWLLFIEFWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 1033753 - protein, 92 aa, Homo sapiens
EWREPVRYRTPRTAMTPREEGIQTLMGRLEDGSRRTGQILKQTYSKFDTNSHNHDALLKNYGLLYCFRKDMDKVETFLRMVQCRSVEGSCGF

SEQ ID NO: 1033754 - protein, 122 aa, Homo sapiens
DTTFPFHITLAEVLHEGSIQAANVCLDIQVFPYILLKSRQSFPKPQFLTSVHPQPNTTCKPPGLCACTLCSNSLSCIDTNSHNHDALLKNYGLLYCFRKDMDKVETFLRMVQCRSVEGSCGF

SEQ ID NO: 1033755 - protein, 217 aa, Homo sapiens; identical to SEQ ID NO: 1033746

SEQ ID NO: 1033756 - protein, 275 aa, Homo sapiens
PGPHGFRGPHGFRGPHGFRGPHGFRGPHGFRAPHGFRGPHGFRAPHGSRVLWTAHLVAMAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 1033757 - protein, 211 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSV

SEQ ID NO: 1033758 - protein, 237 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGTVVYCRILDLQCFCLSASGHTAIS

SEQ ID NO: 1033759 - protein, 227 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYETNSYTRKETIETKDKTIEKKLCGRRQECGFVDTKDKTKQK

SEQ ID NO: 1033760 - protein, 303 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMWVRVAPGVPNPGAPLASRDWGTETLLPSSYHSGADPKELTLFFISPGESSRPFSTPWRGGKENGSMREGGNSPQAPGPSLSSFIFAGRLEDGSRRTGQILKQTYSKFDTNSHNHDALLKNYGLLYCFRKDMDKVETFLRMVQCRSVEGSCGF

SEQ ID NO: 1033761 - protein, 201 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSSPSGNGSRLPDVLLLAFALLCLPWLQSLVPVQTVPLSKGFLDKQLCSKPIVRTKLAIDTYQEFEEAY

SEQ ID NO: 1033762 - protein, 257 aa, Homo sapiens
KFGTKKGRLVTRAGIPPGWAPPPIRGPEAHPGGNWPQGFAERHAPWFFALVHALPFQRVPGPKRPAFFEPKPAKAPAAPPSCGTFDNLGSFKKTLIISKKVPRKLFYALTSSERSPAYSTLSEPPSNHGKKTPNQKTSEELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 1033763 - protein, 82 aa, Homo sapiens
SSFPFFNIFPSKPFLYPFFFTTLFSNPISLTPFTPIIFNKPIQIIHSITPPPSSTFHPTKNICHLHGARAVPQEYVRQQPGV

SEQ ID NO: 1033764 - protein, 123 aa, Homo sapiens
MGFHCVSQDGLKSPDLVIRPSRPPKVLGLQAGATAPGPRILSGNKEKDLEEGIQTLMGRLEDGSRRTGQILKQTYSKFDTNSHNHDALLKNYGLLYCFRKDMDKVETFLRMVQCRSVEGSCGF

SEQ ID NO: 1033765 - protein, 92 aa, Homo sapiens
TEAVVGKSQEQGRQEPGAIATRRAVHRTLSGSGSCGLGILKQTYSKFDTNSHNHDALLKNYGLLYCFRKDMDKVETFLRMVQCRSVEGSCGF

SEQ ID NO: 1033766 - protein, 63 aa, Homo sapiens
MAPGSRTSLLLAFALLCLPWLQSLVPVQTVPLSKGFLDKQLCSKPIVRTKLAIDTYQEFEEAY

SEQ ID NO: 1033767 - protein, 217 aa, Homo sapiens
MAPGSRTSLLLAFALLCLPWLQEGSAFPTIPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 1033768 - protein, 217 aa, Homo sapiens; identical to SEQ ID NO: 1033746

SEQ ID NO: 1033769 - protein, 217 aa, Homo sapiens; identical to SEQ ID NO: 1033767

SEQ ID NO: 1033770 - protein, 215 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSNVYDLLKVPKGRAPQADCAAVPIATPVTGPIFQTDLQQVRHQPNNTDAPNPTNGLIRYTTDTARPLPSTGHAARRRHHSDP

SEQ ID NO: 1033771 - protein, 170 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWRHSGEPAVQGFANSGYGPLDSNVYDLLKDLEEGIQTLMGRLEGYLTQLMTHYSSYGLL

SEQ ID NO: 1033772 - protein, 115 aa, Homo sapiens
ERPPGQVESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 1033773 - protein, 264 aa, Homo sapiens
MAPGSRTSLLLAFALLCLPWLQEEESGFPNIPLSRLFDHAMLQAHRAHQLAIDTYQEFEETYIPKDQKYSFLHDSQTSFCFSDSIPTPSNMEETQQKSNLKLAGISLCGHPIVGGARGSSSGVSSATGWWYGGSDRNVYELLKELEEGIQTLMGRLEDGSRRTGQILKQTYSKFDTNSHNHDALLKNYGVVYWFREWHGPCREFLGTGHAAREGSGVYCRWIREPPGPGRNAHAHWQKNVNKTKDSPQHQGHHDGAREEYPGPR

SEQ ID NO: 1033774 - protein, 729 aa, Homo sapiens
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 1033775 - protein, 456 aa, Homo sapiens
ACEAGSVLSLEEAAGARRRWRGGDPAGITRGLPDPAKMQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKVSI

SEQ ID NO: 1033776 - protein, 726 aa, Homo sapiens
ACEAGSVLSLEEAAGARRRWRGGDPAGITRGLPDPAKMQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLG

SEQ ID NO: 1033777 - protein, 612 aa, Homo sapiens
ACEAGSVLSLEEAAGARRRWRGGDPAGITRGLPDPAKMQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERSK

SEQ ID NO: 1033778 - protein, 677 aa, Homo sapiens
MREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 1033779 - protein, 585 aa, Homo sapiens
ACEAGSVLSLEEAAGARRRWRGGDPAGITRGLPDPAKMQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRK

SEQ ID NO: 1033780 - protein, 50 aa, Homo sapiens
MRSTAEVTGKSQNSNTLAGAWGMKNRRQEAFQRLQRRNQGQPQLPGSFTR

SEQ ID NO: 1033781 - protein, 296 aa, Homo sapiens
MAPEENAGTELLLQSFERRFLAARTLRSFPWQSLEAKLRDSSDSELLRDILHKTVKHPVCVKHPPSVKYARCFLSELIKKPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 1033782 - protein, 363 aa, Homo sapiens
AGLPPGLPATLRPRPRHGARGERGDRTLAAEFRAPLPGGRSLRSFPWQSLEAKLRDSSDSELLRDILQKTVKHPVCVKHPPSVKYARCFLSELIKKCKRLERKQTSSHSACPQHEAVHTEPLDELYEVLAETLMAKESTQGHWSYLLPSGGSVTLSKSTAIISHGTTGLVTWDAALYLAEWAIENPAAFTNRTVLELGSGAGLTGLAICKMCRPRAYIFSDCHSRVLEQLRGNVLLNGLSLEADITANLDSPRVTVAQLDWDVATVHQLSAFQPDVVIAADVLYCPEAIVSLVGVLRRLAACREHQRAPEVYVAFTVRNPETCQLFTTELGRAGIRWEVEARHDQKLFPYEEHLEMAMLNLTL

SEQ ID NO: 1033783 - protein, 118 aa, Homo sapiens
AGLPPGLPATLRPRPRHGARGERGDRTLAAEFRAPLPGGRSLRSFPWQSLEAKLRDSSDSELLRDILQKTCCIAQKPSCRWSGSCGGWLPAGSTSGLLRSTWPLPSATQRRASCSPPS

SEQ ID NO: 1033784 - protein, 132 aa, Homo sapiens
MASRKAMWVPPLLHSESVHSLAKLTKSQHENLVLVQINKCPIKYDSSPNVDTLGSSESQARCSCHIPGHTRFLTKPSPLQLPHPWTHSFLTKPSPLQLPHPWAYGAAGAFFKTGIKVLGTRQKGDTWRPNAG

SEQ ID NO: 1033785 - protein, 503 aa, Homo sapiens
AGLPPGLPATLRPRPRHGARGERGDRTLAAEFRAPLPGGRSLRSFPWQSLEAKLRDSSDSELLRDILQKPSGGSVTLSKSTAIISHGTTGLVTWDAALYLAEWAIENPAAFTSQVTSGRRAGHRGRLTLVQSQTRSPFLPPNRTVLELGSGAGLTGLAICKMCRPRAYIFSDCHSRVLEQLRGNVLLNGLSLEADITANLDSPRVTVAQLDWDVATVHQLSAFQPDVVIAAGNAQPQDSCAGGVLAALPSSGLWEKGTMDAVRHGHDGASRRVTLGLQADIKGQGCLLRSPSSHSPLAGDRHTPITVITTWLCPRAMPCVLQRPQEENNHFWDEDRALERRWCLAGPPKPLTPASTLSPLSGGTELCLWSWVPALKTTGAAVASDTGPPLQASRPISRYLKHEVHGRFRLSAIQSPLDEADVLYCPEAIVSLVGVLRRLAACREHQRAPEVYVAFTVRNPETCQLFTTELGRAGIRWEVEARHDQKLFPYEEHLEMAMLNLTL

SEQ ID NO: 1033786 - protein, 117 aa, Homo sapiens
MAAGRYYTIPSQISPPNLAKIIWPLKKIRTKANKLSLSLPPARGCPHRAFGRAVRGAGGDFDGQGVHPGPLELFAGMRKAPSSPSQPRYPSCTDKVKTWVWVQILTHPFCSLRYEVH

SEQ ID NO: 1033787 - protein, 503 aa, Homo sapiens; identical to SEQ ID NO: 1033785

SEQ ID NO: 1033788 - protein, 198 aa, Homo sapiens
MPGAFSQNSSKSPSGGSVTLSKSTAIISHGTTGLVTWDAALYLAEWAIENPAAFTNRTVLELGSGAGLTGLAICKMCRPRAYIFSDCHSRVLEQLRGNVLLNGLSLEADITANLDSPRVTVAQLDWDVATVHQLSAFQPDVVIAADVLYCPEAIVSLVGVLRRLAACREHQRAPEVYVAFTVRNPETCQLFTTELRLS

SEQ ID NO: 1033789 - protein, 277 aa, Homo sapiens
GGKHFPRTIMPCSKSGWDRCKASSLKCQLPPWTHGFFKSKPIQVANPGHIGSSKAKPFKLHIVDTSGPQKASRCSCTSVTHRSSQAKPLQFHIPDTSVLHKASPLQLHIDTSVLHKAKPAAAATSLDTLGSSQSQARCSCHIGHTRFLTKPSPLQLPHRWTHIGSSESQAHCSCHIPGHTRFLTKPSPLQLPHRWTHSVPQKAKPAAAATSLDTLGSSQSQARCSCHIPGHTRFLTKPSPLQLPHPWAYGAAGAFFKTGIKVLGTRQKGDTWRPNAG

SEQ ID NO: 1033790 - protein, 153 aa, Homo sapiens
MPGAFSQNSSKSNLKIFTVDVLYCPEAIVSLVGVLRRLAACREHQRAPEVYVAFTVRNPETCQLFTTELVESPRPPGPAWSPSCPCRTPVEVKELGAGVKLACPTLPQHAGNSGRGRPGQGRAGIRWEVEARHDQKLFPYEEHLEMAMLNLTL

SEQ ID NO: 1033791 - protein, 296 aa, Homo sapiens; identical to SEQ ID NO: 1033781

SEQ ID NO: 1033792 - protein, 296 aa, Homo sapiens; identical to SEQ ID NO: 1033781

SEQ ID NO: 1033793 - protein, 296 aa, Homo sapiens; identical to SEQ ID NO: 1033781

SEQ ID NO: 1033794 - protein, 296 aa, Homo sapiens; identical to SEQ ID NO: 1033781

SEQ ID NO: 1033795 - protein, 510 aa, Homo sapiens
AGLPPGLPATLRPRPRHGARGERGDRTLAAEFRAPLPGGRSLRSFPWQSLEAKLRDSSDSELLRDILQKPSGGSVTLSKSTAIISHGTTGLVTWDAALYLAEWAIENPAAFTSQVTSGRRAGHRGRLTLVQSQTRSPFLPPNRTVLELGSGAGLTGLAICKMCRPRAYIFSDCHSRVLEQLRGNVLLNGLSLEADITANLDSPRVTVAQLDWDVATVHQLSAFQPDVVIAAGNAQPQDSCAGGVLAALPSSGLWEKGTMDAVRHGHDGASRRVTLGLQADIKGQGCLLRSPSSHSPLAGDRHTPITVITTWLCPRAMPCVLQRPQEENNHFWDEDRALERRWCLAGPPKPLTPASTLSPLSGGTELCLWSWVPALKTTGAAVASDTGPPLQASRPISRYLKHEVHGRFRLSAIQSPLDRPTCCIAQKPSCRWSGSCGGWLPAGSTSGLLRSTWPLPSATQRRASCSPPSYGCPSSPTQYAHVLSPNTAIFKHMCSVSRPGWDQMGSGSSS

SEQ ID NO: 1033796 - protein, 218 aa, Homo sapiens
AGLPPGLPATLRPRPRHGARGERGDRTLAAEFRAPLPGGRSLRSFPWQSLEAKLRDSSDSELLRDILQKTVKHPVCVKHPPSVKYARCFLSELIKKCKRLERKQTSSHSACPQHEAVHTEPLDELYEVLAETLMAKESTQGHWSYLLPSGGSVTLSKSTAIISHGTTGLVTWDAALYLAEWAIENPAAFKAGLGSDGKWKLVMTRNCFPTKSTWRWQC

SEQ ID NO: 1033797 - protein, 395 aa, Homo sapiens
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRFDGSFIYVIFRTHLETPTPLKIESQYCLVNLYINQERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 1033798 - protein, 366 aa, Homo sapiens
KLRLGRGLVWRNTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 1033799 - protein, 319 aa, Homo sapiens
MSRNETEHRYLGTHFGAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 1033800 - protein, 342 aa, Homo sapiens
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 1033801 - protein, 360 aa, Homo sapiens
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 1033802 - protein, 234 aa, Homo sapiens
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRFGPISPGISRFITRPMKI

SEQ ID NO: 1033803 - protein, 360 aa, Homo sapiens; identical to SEQ ID NO: 1033801

SEQ ID NO: 1033804 - protein, 292 aa, Homo sapiens
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTESSRSSQTYEIDNVGFDLSSTVLGPGGLPSPSGGVPPSSVPWRVAPGSGAGG

SEQ ID NO: 1033805 - protein, 297 aa, Homo sapiens
KLRLGRGLVWRNTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTESSRSSQTYEIDNGDVTFRPRLGAGGFALPQWWRAPEFCALAGCPGVGRGG

SEQ ID NO: 1033806 - protein, 360 aa, Homo sapiens; identical to SEQ ID NO: 1033801

SEQ ID NO: 1033807 - protein, 466 aa, Homo sapiens
SSSHTRGQGAGGPQLRRRRVPPGPTSAPPSGALEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 1033808 - protein, 444 aa, Homo sapiens
GGGRAPLVGGNGAGRALQGSAWRSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 1033809 - protein, 469 aa, Homo sapiens
EELALGADSLELAERTHPTFPHPGTGPTSAPPSGALEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 1033810 - protein, 480 aa, Homo sapiens
EELALGADSLELAERTHPTFPHPGTGPTSAPPSGALEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKTGAELGTCGREDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 1033811 - protein, 211 aa, Homo sapiens
EELALGADSLELAERTHPTFPHPGTGPTSAPPSGALEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRQQSQGFGKELCQAKPERPMM

SEQ ID NO: 1033812 - protein, 469 aa, Homo sapiens; identical to SEQ ID NO: 1033809

SEQ ID NO: 1033813 - protein, 209 aa, Homo sapiens [sequence omitted]

SEQ ID NO: 1033814 - protein, 399 aa, Homo sapiens
MAEEMVEAAGEDERELAAEMAAAFLNENLPESIFGAPKAGNGQWASVIRVMNPIQGNTLDLVQLEQNEAAFSVAVCRFSNIGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033815 - protein, 399 aa, Homo sapiens; identical to SEQ ID NO: 1033814

SEQ ID NO: 1033816 - protein, 399 aa, Homo sapiens; identical to SEQ ID NO: 1033814

SEQ ID NO: 1033817 - protein, 1087 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033818 - protein, 373 aa, Homo sapiens
LRRGRVLFGRGKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033819 - protein, 293 aa, Homo sapiens
SVWLAFYNSCIYLLFLYKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033820 - protein, 232 aa, Homo sapiens
MVVHDHLCLLGGPIEQATVPQGFVSCRILIYFIIGVRWEPHHTYVAKLVCASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033821 - protein, 769 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELDVYMAILFLNVSCIPFCNILFGDSTFPILLLRTLPFFIDIILFLSLYLRVTLPLARVSPLRLPSP

SEQ ID NO: 1033822 - protein, 1069 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033823 - protein, 387 aa, Homo sapiens
EVPWIIPVAAQPINENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033824 - protein, 1087 aa, Homo sapiens; identical to SEQ ID NO: 1033817

SEQ ID NO: 1033825 - protein, 312 aa, Homo sapiens
GHSVFQPGRLPLLAIPTHSFLPGSVRNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033826 - protein, 1055 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFSPFLTLTFCPSHYSVYA

SEQ ID NO: 1033827 - protein, 927 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVS

SEQ ID NO: 1033828 - protein, 658 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPTHP

SEQ ID NO: 1033829 - protein, 399 aa, Homo sapiens; identical to SEQ ID NO: 1033814

SEQ ID NO: 1033830 - protein, 399 aa, Homo sapiens; identical to SEQ ID NO: 1033814

SEQ ID NO: 1033831 - protein, 399 aa, Homo sapiens; identical to SEQ ID NO: 1033814

SEQ ID NO: 1033832 - protein, 399 aa, Homo sapiens; identical to SEQ ID NO: 1033814

SEQ ID NO: 1033833 - protein, 399 aa, Homo sapiens; identical to SEQ ID NO: 1033814

SEQ ID NO: 1033834 - protein, 104 aa, Homo sapiens
GNKFPSAAALAEDGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033835 - protein, 399 aa, Homo sapiens; identical to SEQ ID NO: 1033814

SEQ ID NO: 1033836 - protein, 399 aa, Homo sapiens; identical to SEQ ID NO: 1033814

SEQ ID NO: 1033837 - protein, 1069 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKLEDIRTRYAF

SEQ ID NO: 1033838 - protein, 368 aa, Homo sapiens
MKLFLDIRYNYPMSDSLDPRDIIGNMLILTFSEELLLSQVIDTQQLPHTNQHPPLEWGNSSKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 1033839 - protein, 820 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKVGICQWFS

SEQ ID NO: 1033840 - protein, 487 aa, Homo sapiens
MISAIEKQKLVYIYNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNLVDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEGGLVKVLITTDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEVPNGGSHVGAVLAVPREKGRPGGGGRGNSGP

SEQ ID NO: 1033841 - protein, 201 aa, Homo sapiens
HWTENLHQKNVCPETDEVLQLQLLIGSFPKAHLILPRTEISTGFYSFCQVHQIHQVRAVLTTTTFPFVSIMSWKKALRIPGDLRVATVTLMLAMLSSPLAEGRDSPEDFVYQFKGMCYFTNGTERVRGVTRYIYNREEYARFDSDVGVYRAVTPQGRPDAEYWNSQKDSPGGDPGGVGHGVQTQLRGGATAGSCRGEWSPQ

SEQ ID NO: 1033842 - protein, 236 aa, Homo sapiens
HWTENLHQKNVCPETDEVLQLQLLIGSFPKAHLILPRTEISTGFYSFCQVHQIHQVRAVLTTTTFPFVSIMSWKKALRIPGDLRVATVTLMLAMLSSPLAEGRDSPEDFVYQFKGMCYFTNGTERVRGVTRYIYNREEYARFDSDVGVYRAVTPLGRPDAEYWNSQKDILERTRAELDTVCRHNYEVALPRDPAEESGAHSDHLPIQDRGPQPPQPAGLLGDRFLSRPDQSPVVSE

SEQ ID NO: 1033843 - protein, 236 aa, Homo sapiens; identical to SEQ ID NO: 1033842

SEQ ID NO: 1033844 - protein, 201 aa, Homo sapiens; identical to SEQ ID NO: 1033841

SEQ ID NO: 1033845 - protein, 306 aa, Homo sapiens
HWTENLHQKNVCPETDEVLQLQLLIGSFPKAHLILPRTEISTGFYSFCQVHQIHQVRAVLTTTTFPFVSIMSWKKALRIPGDLRVATVTLMLAMLSSPLAEGRDSPEDFVYQFKGMCYFTNGTERVRGVTRYIYNREEYARFDSDVGVYRAVTPLGRPDAEYWNSQKDILEKSWRGPGRSWTRCADTTTSWSSARPCSGDGPKIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGLLH

SEQ ID NO: 1033846 - protein, 236 aa, Homo sapiens; identical to SEQ ID NO: 1033842

SEQ ID NO: 1033847 - protein, 269 aa, Homo sapiens [sequence omitted]

SEQ ID NO: 1033848 - protein, 261 aa, Homo sapiens [sequence omitted]

SEQ ID NO: 1033849 - protein, 261 aa, Homo sapiens [sequence omitted]

SEQ ID NO: 1033850 - protein, 261 aa, Homo sapiens [sequence omitted]

SEQ ID NO: 1033851 - protein, 201 aa, Homo sapiens; identical to SEQ ID NO: 1033841

SEQ ID NO: 1033852 - protein, 166 aa, Homo sapiens
MDVVDRQLPPRLCGTRVLTGVSALATIVSRGCRTDPMIAVVHGVFPIPPDTPGVIGTEQSGKLTMACYSEPCQQWEVASKQRGKPSMDKGQTHGTSHTPPRLTGAASRAFPAQTASGFKQRPYSVAVPAFSQGLDDYGARSMSRNPFAHVQLKPTVTNDRSAPLLS

SEQ ID NO: 1033853 - protein, 552 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRCDLSAQGPEGREHGDGSARTLAGR

SEQ ID NO: 1033854 - protein, 534 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 1033855 - protein, 516 aa, Homo sapiens
MATENAGSRYVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1033856 - protein, 262 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGQGRTGPCVETLPRRRSRSAKDFKSRGFHAQWMNVDTKQQHLYEDVKC

SEQ ID NO: 1033857 - protein, 87 aa, Homo sapiens
MSLSRSEEMHRLTENVYKSINAMLPYVASAQFILPVRVEELRYFLIPVSWYCASLSGPAMISICQIRKFRELVSVRECNISLIRVEL

SEQ ID NO: 1033858 - protein, 590 aa, Homo sapiens
LGGSGPLSSPSCCRYRRCCRRLRPPLRSVVQPGPRTMSLSRSEEMHRLTENVYKRVEEKYQRNLFPIFSPSALKPESRNFRGESWQGTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1033859 - protein, 278 aa, Homo sapiens
MQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1033860 - protein, 443 aa, Homo sapiens
MAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1033861 - protein, 228 aa, Homo sapiens
LGGSGPLSSPSCCRYRRCCRRLRPPLRSVVQPGPRTMSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQGWPLEGRWYFRFLEGAASVLFSHRHAGVT

SEQ ID NO: 1033862 - protein, 534 aa, Homo sapiens; identical to SEQ ID NO: 1033854

SEQ ID NO: 1033863 - protein, 520 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 1033864 - protein, 534 aa, Homo sapiens; identical to SEQ ID NO: 1033854

SEQ ID NO: 1033865 - protein, 522 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTAENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1033866 - protein, 89 aa, Homo sapiens
EPLRPIEPGGSVLLRELAAGNVADATLAQAPLLHALGAAHAYIMMFVHTCRVGQSERSRSAKDFKSRGFHAQWMNVDTKQQHLYEDVKC

SEQ ID NO: 1033867 - protein, 570 aa, Homo sapiens
LGGSGPLSSPSCCRYRRCCRRLRPPLRSVVQPGPRTMSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 1033868 - protein, 494 aa, Homo sapiens
ESSILPACLGRRQGWACVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1033869 - protein, 249 aa, Homo sapiens
ASLNPLYSPIRASPASPGCPFWAFLPGGLMTLARCEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 1033870 - protein, 135 aa, Homo sapiens
KIIAIMNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKK

SEQ ID NO: 1033871 - protein, 135 aa, Homo sapiens; identical to SEQ ID NO: 1033870

SEQ ID NO: 1033872 - protein, 125 aa, Homo sapiens
GRVGRPTRRAKKLGSPCPRKSKPMSPKLRRRRSRRPPGGGGRHRGSGVASSSEDLCSGVLGPGRGPALPWSLAPPPAPGAQWSRLGELPAPRSGAGQAAQTYCGGREGRLLPGDGTRRPTRTRHR

SEQ ID NO: 1033873 - protein, 128 aa, Homo sapiens
PLFRFPKGGPKKRKSWWSPCPRKSKPMSPKLRRRRSRRPPGGGGRHRGSGVASSSEDLCSGVLGPGRGPALPWSLAPPPAPGAQWSRLGELPAPRSGAGQAAQTYCGGREGRLLPGDGTRRPTRTRHR

SEQ ID NO: 1033874 - protein, 198 aa, Homo sapiens [sequence omitted]

SEQ ID NO: 1033875 - protein, 271 aa, Homo sapiens
MLPAAARPLWGPCLGLRAAAFRLARRQVPCVCAVRHMRSSGHQRCEALAGAPLDNAPKEYPPKIQQLVQDIASLTLLEISDLNELLKKTLKIQDVGLVPMGGVMSGAVPAAAAQEAVEEDIPIAKERTHFTVRLTEAKPVDKVKLIKEIKNYIQGINLVQAKKLVESLPQEIKANVAKAEAEKIKAAPWRRWAAPWFWSSLQLGGLVFRGPGPRARSRPPVVTGSAQTGGSGVLEIAGSRGGKRKTTCGEGGGCAVRPKPRGPEGPGVKNG

SEQ ID NO: 1033876 - protein, 122 aa, Homo sapiens
TRGSTHASGKEAGINLVQAKKLVESLPQEIKANVAKAEAEKIKAAPWRRWAAPWFWSSLQLGGLVFRGPGPRARSRPPVVTGSAPSTRRPVEPFGRIACATQRGRTGRTDLLWREGGAAAAW

SEQ ID NO: 1033877 - protein, 168 aa, Homo sapiens
MLPAAARPLWGPCLGLRAAAFRLARRQVPCVCAVRHMRSSGHQRCEALAGAPLDNAPKEYPPKIQQLVQDIASLTLLEISDLNELLKKTLKIQDVGLVPMGGVMSGAVPAAAAQEAVEEDIPIAKERTHFTVRLTEAKPVDKVKLIKEIKNYIQGINLVQAKKLVVLE

SEQ ID NO: 1033878 - protein, 198 aa, Homo sapiens
MLPAAARPLWGPCLGLRAAAFRLARRQVPCVCTVRHMRSSGHQRCEALAGAPLDNAPKEYPPKIQQLVQDIASLTLLEISDLNELLKKTLKIQDVGLVPMGGVMSGAVPAAAAQEAVEEDIPIAKERTHFTVRLTEAKPVDKVKLIKEIKNYIQGINLVQAKKLVESLPQEIKANVAKAEAEKIKAALEAVGGTVVLE

SEQ ID NO: 1033879 - protein, 198 aa, Homo sapiens; identical to SEQ ID NO: 1033878

SEQ ID NO: 1033880 - protein, 73 aa, Homo sapiens
GYSRTTVPPTFDGRCSSYVARHRPAPGAQWSRLGELPAPRSGAGQAAQTYCGGREGRLLPGDGTRRPTRTRHR

SEQ ID NO: 1033881 - protein, 506 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 1033882 - protein, 525 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEGRWACCSWEFPDHKPTHSLPLRQLFGSQRGP

SEQ ID NO: 1033883 - protein, 525 aa, Homo sapiens; identical to SEQ ID NO: 1033882

SEQ ID NO: 1033884 - protein, 541 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNIFFSIGLRKGNHPEPRKCRFTQFNLECGNSSPPPFITSPCA

SEQ ID NO: 1033885 - protein, 476 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDLS

SEQ ID NO: 1033886 - protein, 352 aa, Homo sapiens
MFLESLMKSLILFSSSLQVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 1033887 - protein, 354 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQWGLFQP

SEQ ID NO: 1033888 - protein, 102 aa, Homo sapiens
PTDPQFAFVTSRHSLAVLAASALKVGGPAVLGSSQITSQHTHCLLGSSLGVRGAHERGQLNSHLAGHLSTRLLLRMKTGRFPGTPCLGTFSHRISAGSGRHL

SEQ ID NO: 1033889 - protein, 506 aa, Homo sapiens; identical to SEQ ID NO: 1033881

SEQ ID NO: 1033890 - protein, 438 aa, Homo sapiens
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 1033891 - protein, 525 aa, Homo sapiens; identical to SEQ ID NO: 1033882

SEQ ID NO: 1033892 - protein, 591 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNIFFSIGLRKGNHPKPRKGRSTQFKLEGGNRLPSSLNNRSGGLKQFRYLKRKPLGLGNGGGPRGTKAEKTQAEEHYRFAQIANTFDLDTETH

SEQ ID NO: 1033893 - protein, 488 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 1033894 - protein, 349 aa, Homo sapiens
RPPTQLSGPGGKMAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQW

SEQ ID NO: 1033895 - protein, 296 aa, Homo sapiens
MANVLCNRARLVSYLPGFCSLVKRVVNPKAFSTAGSSGSDESHVAAAPPDICSRTVWPDETMGPFGPQDQRFQLPGNIGFDCHLNGTASQKKSLVHKTLPDVLAEPLSSERHEFVMAQYVNEFQGNDAPVEQEINSAETYFESARVECAIQTCPELLRKDFESLFPEVANGKLMILTVTQKTKNDMTVWSEEVEIEREVLLEKFINGAKEICYALRAEGYWADFIDPSSGLAFFGPYTNNTLFETDERYRHLGFSVDDLGCCKVIRHSLWGTHVVVGSIFTNATPDSHIMKKLSGN

SEQ ID NO: 1033896 - protein, 296 aa, Homo sapiens; identical to SEQ ID NO: 1033895

SEQ ID NO: 1033897 - protein, 107 aa, Homo sapiens
SGSCTAGSGLGDLCLAWGRVLASLGYGESLDFGPDVVDDTPLRKSGRYLSCLLLEFNRSLLCFVVFFPRNNFTKGKLFVRTIFSSGDGQCACVTEPDWFPISQDFAL

SEQ ID NO: 1033898 - protein, 74 aa, Homo sapiens
PSSETEWFYLPGLSIRVSIPKPFRLQDHQVRMSLMWLLHPPDICSRTVWPDETYGTLVWTSRSEVPASWGTIGL

SEQ ID NO: 1033899 - protein, 133 aa, Homo sapiens
MCNELHSLLWWQGDHAECSASHGAWEQGPGEKYFQYSLSQQFIPSGSPMAGRLHVGLLCACASSFRRARKQLPLPAHRQRRCYHRCRRRRHFDGRKSPVLGQLETVVVTEITLPKESYLCELSSPAEMANVLV

SEQ ID NO: 1033900 - protein, 154 aa, Homo sapiens
MCNELHSLLWWQGDHAECSASHGAWEQGPGEKYFQYSLSQQFIPSGSPMAGRLHVGLLCACASSFRRARKQLPLPAHRQRRCYHRCRRRRHFDGRKSPVLGQLETVVVTVRMVSAHVSPSKFARVGVTALEITLPKESYLCELSSPAEMANVLV

SEQ ID NO: 1033901 - protein, 130 aa, Homo sapiens
MCNELHSLLWWQGDHAECSASHGAWEQGPGEKYFQYSLSQQFIPSGSPMAGRLHVGLLCACASSFRRARKQLPLPAHRQRRCYHRCRRRRHFDGRKSPVLGQLETVVVTEITLPKESYLCELSSPAEMAN

SEQ ID NO: 1033902 - protein, 78 aa, Homo sapiens
SSHEELLSEAYWIVTLRPGPWSIPKPFRLQDHQVRMSLMWLLHPPDICSRTVWPDETYGTLVWTSRSEVPASWGTIGL

SEQ ID NO: 1033903 - protein, 133 aa, Homo sapiens; identical to SEQ ID NO: 1033899

SEQ ID NO: 1033904 - protein, 106 aa, Homo sapiens
MAGRLHVGLLCACASSFRRARKQLPLPAHRQRRCYHRCRRRRHFDGRKSPVLGQLETVVVTVRMVSAHVSPSKFARVGVTALEITLPKESYLCELSSPAEMANVLV

SEQ ID NO: 1033905 - protein, 266 aa, Homo sapiens [sequence omitted]

SEQ ID NO: 1033906 - protein, 266 aa, Homo sapiens
MVCLKLPGGSCMTALTVTLMVLSSPLALAGDTRPRFLWQLKFECHFFNGTERVRLLERCIYNQEESVRFDSDVGEYRAVTELGRPDAEYWNSQKDLLEQRRAAVDTYCRHNYGVGESFTVQRRVEPKVTVYPSKTQPLQHHNLLVCSVSGFYPGSIEVRWFRNGQEEKAGVVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 1033907 - protein, 192 aa, Homo sapiens
CSRIATHKCCWLGLFCAIKALEPDCQLGCQPPSCTPYKLRPALPAVPGEALPAAGTGRTEKAGGQEDPLLPTAPEKRAVPDRMCRHNYELDEAMTLQRRVQPKVNVSPSKKGPLQHHNLLVCHVTDFYPGSIQVRRFLNGQEETVGVGSTNLIRNEDGPFKFWVMLEMTPQKEEVYTCQVEHTSLNSPVPVN

SEQ ID NO: 1033908 - protein, 72 aa, Homo sapiens
QQCYRRTVLFIRGAFSVHHLPLRTGPVLFSSMVCLKLPGGSCMAALTVTLMVLSSPLALAGDTRPRFLWQDK

SEQ ID NO: 1033909 - protein, 266 aa, Homo sapiens [sequence omitted]

SEQ ID NO: 1033910 - protein, 142 aa, Homo sapiens
MPKVTVYPSKTQPLQHHNLLVCSVSGFYPGSIEVRWFRNGQEEKAGVVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 1033911 - protein, 219 aa, Homo sapiens
MKRVQYLNRYIHKREENLRFDSNVEEFQAVTELGRPVAENWNSQKGIPEEKRDKMDDYCRYNYGVFESFTVQPRVHPKVTVILYPSKTQPLQHHNLLVCSVSGFYPGSIEVRWFRNGQEEKAGVVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 1033912 - protein, 185 aa, Homo sapiens
MASCAIGLVKARAWVCREADTQPNQETYSVFLTHSLYVVFLLVQPKVTVYPSKTQPLQHHNLLVCSVSGFYPGSIEVRWFRNGQEEKAGVVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 1033913 - protein, 267 aa, Homo sapiens
MVCLKLPGGSCMAALTVTLMVLSSPLALAGDTRPRFLWQLKFECHFFNGTERVRLLERCIYNQEEYVRFDSDVGEYRAVTELGRPDAEYWNSQKDILEDRRGPRWTPTADTTTGLVRASQCSGESILKVTVYPSKTQPLQHHNLLVCSVSGFYPGSIEVRWFRNGQEEKAGVVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 1033914 - protein, 103 aa, Homo sapiens
FSVPDCQLYPSRESITGSWCFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 1033915 - protein, 123 aa, Homo sapiens
MSAVCLRVVTNLSCMNTKTTGSLLRPSFQHVACVRSSFLSVDLVYPVAKNPMPPVHATHITFPVVLACEMGFLSSALNVQRRFPGHVQRQRQTWACVSDMAWIQQVDDLDPSETWLDAGEQVP

SEQ ID NO: 1033916 - protein, 142 aa, Homo sapiens; identical to SEQ ID NO: 1033910

SEQ ID NO: 1033917 - protein, 192 aa, Homo sapiens
RGSSSSSCLEVSRIGWRRGGGPKSLGIRRGFPAWSPRQPVRLRKTEDEPLGCAGRGYGWDQLRFQCPHPAQEPRMAASLSVSSQEAAPVTGSFVSPQHVSCSRISSECHFFNGTERVRFLDRYFYNQEEYVRFDSDVGEYRAVTELGRPDAEYWNSQKDILEDRRGPRWTPTADTTTGLVRASQCSGELSLR

SEQ ID NO: 1033918 - protein, 185 aa, Homo sapiens; identical to SEQ ID NO: 1033912

SEQ ID NO: 1033919 - protein, 146 aa, Homo sapiens
MCRHNYELDEAMTLQRRVQPKVNVSPSKKGPLQHHNLLVCHVTDFYPGSIQVRRFLNGQEETVGVGSTNLIRNEDGPSKFWVMLEMTPQEGKRLHLPSGAHQLDSLSRGWKAHLLPGVRLDGGGSGAHHLWIGISCTGGASSGLHR

SEQ ID NO: 1033920 - protein, 103 aa, Homo sapiens
MVGTLRALRTGDAGGRYLGGDVMLRGWPCIACRYLDTANIGTILGMIRRRLRSGSSLPADTSETYSGLRRKSITQVLSVAEIQSLKADYIPSNGTQTHWQDHR

SEQ ID NO: 1033921 - protein, 266 aa, Homo sapiens [sequence omitted]

SEQ ID NO: 1033922 - protein, 102 aa, Homo sapiens
MPLRLDIKRKLTARSDRVKSVDLHPTEPWMLASLYNGSVCVWNHETQVGIFQDFIRNKILCETVFIMKEKKYYNRIQNLYANCFLKLVQSILNMKELTFMRG

SEQ ID NO: 1033923 - protein, 906 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033924 - protein, 887 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYILLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033925 - protein, 644 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033926 - protein, 928 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLFWGPKWGPFFPPPFFFCGGGGKKQFGLKTNWLGNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033927 - protein, 921 aa, Homo sapiens
SGSRKFHVSQSDGQWIPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033928 - protein, 877 aa, Homo sapiens
MLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033929 - protein, 904 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKQPDPWPLEPTGHLDGARDTAGPSWLHHRF

SEQ ID NO: 1033930 - protein, 906 aa, Homo sapiens; identical to SEQ ID NO: 1033923

SEQ ID NO: 1033931 - protein, 906 aa, Homo sapiens; identical to SEQ ID NO: 1033923

SEQ ID NO: 1033932 - protein, 904 aa, Homo sapiens; identical to SEQ ID NO: 1033929

SEQ ID NO: 1033933 - protein, 584 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKEPPAQEPQGTDARTS

SEQ ID NO: 1033934 - protein, 177 aa, Homo sapiens
MPLVFIDAIGVIDATGVIDATGVYTMPRACGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLASINTGVYRCHRIVLPGAPEG

SEQ ID NO: 1033935 - protein, 888 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033936 - protein, 755 aa, Homo sapiens
MVLLNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033937 - protein, 877 aa, Homo sapiens; identical to SEQ ID NO: 1033928

SEQ ID NO: 1033938 - protein, 877 aa, Homo sapiens; identical to SEQ ID NO: 1033928

SEQ ID NO: 1033939 - protein, 681 aa, Homo sapiens
MGLFHLTQFIVDVCIKREYLHCSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033940 - protein, 361 aa, Homo sapiens
ADGNLMPLQAEFRRYCSLTHPPTAHPLLCGLIPNRPQTGCLGDPWFKSLFFNALMEHGKEILDFLSFGYFAEELDLRPTIKEEGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1033941 - protein, 906 aa, Homo sapiens; identical to SEQ ID NO: 1033923

SEQ ID NO: 1033942 - protein, 906 aa, Homo sapiens; identical to SEQ ID NO: 1033923

SEQ ID NO: 1033943 - protein, 297 aa, Homo sapiens [sequence omitted]

SEQ ID NO: 1033944 - protein, 103 aa, Homo sapiens
MGQNVADYMRYLMEEDEDAYKKQFSQYIKNSVTPDMMEEMYKKAHAAIRENPVYEKKPKKEVKEDGGPSKCSLSEEDRVLKKGGLKSEGGGNNHILGFPLIKL

SEQ ID NO: 1033945 - protein, 183 aa, Homo sapiens [sequence omitted]

SEQ ID NO: 1033946 - protein, 183 aa, Homo sapiens [sequence omitted]

SEQ ID NO: 1033947 - protein, 183 aa, Homo sapiens [sequence omitted]

SEQ ID NO: 1033948 - protein, 123 aa, Homo sapiens
MDKIYEGQVEVTGDEYNVESIDGQPGAFTCYLDAGLARTTTGNKVFGALKGAVDGGLSIPHSTKRFPGYDSESKEFNAEVHRKPSGAQVAITAPLTGPMTSLKTVPHLRRIPHLGMSASGTPA

SEQ ID NO: 1033949 - protein, 144 aa, Homo sapiens
PGYDSESKESFGTVRDRQASIHSSKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1033950 - protein, 53 aa, Homo sapiens
MFRTTFTPYLAHRKHIMGQNVADYMRYLMEEDEDAYKLSYSTMSFLIHLLHHV

SEQ ID NO: 1033951 - protein, 183 aa, Homo sapiens [sequence omitted]

SEQ ID NO: 1033952 - protein, 183 aa, Homo sapiens [sequence omitted]

SEQ ID NO: 1033953 - protein, 118 aa, Homo sapiens
MDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSLN

SEQ ID NO: 1033954 - protein, 189 aa, Homo sapiens
MVADACNPSTLGGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1033955 - protein, 115 aa, Homo sapiens
LLLLLLNWRRSTHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1033956 - protein, 165 aa, Homo sapiens
MDKIYEGQVEVTGDEYNVESIDGQPGAFTCYLDAGLARTTPGTTVLVPARDCGAGCYPSRSRIPGMSLKAGTLRRLGASWPRLRYWTTGPTVQKVPIHRFPWDFSRYKRLTKYKCHFKLQASGGPVYQRLLFYLSTSQLHTHIVKPEGTTHSHPTSNVPRHPLVA

SEQ ID NO: 1033957 - protein, 106 aa, Homo sapiens
MAWSGVQMVSFPPRIRHEDLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1033958 - protein, 183 aa, Homo sapiens [sequence omitted]

SEQ ID NO: 1033959 - protein, 277 aa, Homo sapiens
MGFVKVVKNKAYFKRYQVKFRRRREGKTDYYARKRLVIQDKNKYNTPKYRMIVRVTTAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1033960 - protein, 133 aa, Homo sapiens
PSSTTTKLAAARPKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 1033961 - protein, 368 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLPAQLVLSFLHLHQCPRPPWL

SEQ ID NO: 1033962 - protein, 368 aa, Homo sapiens; identical to SEQ ID NO: 1033961

SEQ ID NO: 1033963 - protein, 368 aa, Homo sapiens; identical to SEQ ID NO: 1033961

SEQ ID NO: 1033964 - protein, 325 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPGQSSMGVGCGRWGAAPQS

SEQ ID NO: 1033965 - protein, 129 aa, Homo sapiens
MPGCTERGATCGRGGGWGLRAKVVAHWRSRERSPAAVRRWDSRTLDASTSAEPLGRRGRVRLQLWPVLRPLTLRPQRPALTWLIWSGPWSQFPTPSEAPPSTSYSLHQEGLEPSACTSSTLRKLSGGQS

SEQ ID NO: 1033966 - protein, 383 aa, Homo sapiens
RALPLLAAGQKGQDLRRLRESQLCGQELEVLPPTASGCRENHEACFPQVPLKGAAVGPPRCQPPQPASPANDVGISESPQSAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLPAQLVLSFLHLHQCPRPPWL

SEQ ID NO: 1033967 - protein, 276 aa, Homo sapiens
SGGREGLIEVTLELKFEGHGMNHVTKEAANKPWGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLPAQLVLSFLHLHQCPRPPWL

SEQ ID NO: 1033968 - protein, 200 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLAPAQLVLSFLHLHQCPRPPWL

SEQ ID NO: 1033969 - protein, 91 aa, Homo sapiens
QRSWKTKGLEAWTEATAQHTHILPLGSKSNSPPALGPEACPVSLPSPPEASTLKGPPPEAAESTGMTQLLPHRLQGESGPSLTSPTSPGPH

SEQ ID NO: 1033970 - protein, 325 aa, Homo sapiens; identical to SEQ ID NO: 1033964

SEQ ID NO: 1033971 - protein, 368 aa, Homo sapiens; identical to SEQ ID NO: 1033961

SEQ ID NO: 1033972 - protein, 368 aa, Homo sapiens; identical to SEQ ID NO: 1033961

SEQ ID NO: 1033973 - protein, 326 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPAQLVLSFLHLHQCPRPPWL

SEQ ID NO: 1033974 - protein, 326 aa, Homo sapiens; identical to SEQ ID NO: 1033973

SEQ ID NO: 1033975 - protein, 326 aa, Homo sapiens; identical to SEQ ID NO: 1033973

SEQ ID NO: 1033976 - protein, 328 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGAHPQHPHLLINISTPCST

SEQ ID NO: 1033977 - protein, 312 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALQVFSELGFPPAVQRWVIGRCLCVPERSLASYGVRQDGDPAFLYLLSAPREAPGQSSMGVGCGRWGAAPQS

SEQ ID NO: 1033978 - protein, 190 aa, Homo sapiens
IYRILKVVVGKGAAQVAAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLPAQLVLSFLHLHQCPRPPWL

SEQ ID NO: 1033979 - protein, 170 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNSLASYGVRQDGDPAFLYLLSAPREAPAQLVLSFLHLHQCPRPPWL

SEQ ID NO: 1033980 - protein, 368 aa, Homo sapiens; identical to SEQ ID NO: 1033961

SEQ ID NO: 1033981 - protein, 368 aa, Homo sapiens; identical to SEQ ID NO: 1033961

SEQ ID NO: 1033982 - protein, 81 aa, Homo sapiens
MPGCTERGAACGRGGGWGLRAKVVAHWRSRERSPAAVRRWDSRTLDASTSAEPLGRRGRVRLQLWPVLRPLTLRPQRPALT

SEQ ID NO: 1033983 - protein, 396 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRGGLGAASSPCPRDHPRSPSIPEPTFWHRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLPAQLVLSFLHLHQCPRPPWL

SEQ ID NO: 1033984 - protein, 298 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNAVLAQHRVALSVQLQEACFPPGPIRLQVTLEDAASAASAASSAHVALQVHPHCTVAALQEQVFSELGFPPAVQRWVIGRCLCVPERSLASYGVRQDGDPAFLYLLSAPREAPATGPSPQHPQKMDGELGRLFPPSLGLPPGPQPAASSLPSPLPAQLVLSFLHLHQCPRPPWL

SEQ ID NO: 1033985 - protein, 187 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGQCPVMDTITIWNSLGPPVLVGEVGSTFPTAGVWEGFQEGVGGAWSSLEYLEWLLESVSYTI

SEQ ID NO: 1033986 - protein, 157 aa, Homo sapiens
MIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 1033987 - protein, 191 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 1033988 - protein, 191 aa, Homo sapiens; identical to SEQ ID NO: 1033987

SEQ ID NO: 1033989 - protein, 191 aa, Homo sapiens; identical to SEQ ID NO: 1033987

SEQ ID NO: 1033990 - protein, 191 aa, Homo sapiens; identical to SEQ ID NO: 1033987

SEQ ID NO: 1033991 - protein, 153 aa, Homo sapiens
MLYIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 1033992 - protein, 229 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEGLALPPRLECSGMITAHCSLNLPRAWWSSCLSPLLGLQVTIVVLGNKCDLQEQRRVDPDVAQHWAKSEKVKLWEVSVADRRSLLEPFVYLASKMTQPQSKSAFPLSRKNKGSGSLDG

SEQ ID NO: 1033993 - protein, 191 aa, Homo sapiens; identical to SEQ ID NO: 1033987

SEQ ID NO: 1033994 - protein, 111 aa, Homo sapiens
MGKSCKVVVCGQASVGKTSILEQLLYGNHVVGSEMIETQEDIYVGSIETDRGVRELPFLSPPSLLPIPAFRGSAPLSPGAVVGHCPFQLPQTGSRVTTQQCPFLGLSSYYR

SEQ ID NO: 1033995 - protein, 191 aa, Homo sapiens; identical to SEQ ID NO: 1033987

SEQ ID NO: 1033996 - protein, 104 aa, Homo sapiens
AGRKLGSGQAAGAGPGGAYTDSGGRLEPLRRRCPSPGPRELGGPGWCCGGPGRLKTKHGEELQGGRVWPGVCGQNFNPGAASVWEPCSGFGDDRDAGGHLRGLH

SEQ ID NO: 1033997 - protein, 171 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPEQVCLPPQPEEQGQRLLGWLKSCRSSFTIPAPFQCLGLW

SEQ ID NO: 1033998 - protein, 135 aa, Homo sapiens
MGKSCKVVVCGQASVGKTSILEQLLYGNHVVGSEMIETQEDIYVGSIETDRGVREQVTIVVLGNKCDLQEQRRVDPDVAQHWAKSEKVKLWEVSVADRRSLLEPFVYLASKMTQPQSKSAFPLSRKNKGSGSLDG

SEQ ID NO: 1033999 - protein, 142 aa, Homo sapiens
MAGVLAEGGASPQQLVAASLAGTSFPEPTELQVASSTTLLPGYLFGSWSVEQLPARSPPLPHRTPRQPPSYRRDQRAGWEAGGEEHFRLEHRAAPRRLRPEGLPRARLPERGSAWGQSGTPDPRMSTVGLRDRGGSPGAVPG

SEQ ID NO: 1034000 - protein, 191 aa, Homo sapiens; identical to SEQ ID NO: 1033987

SEQ ID NO: 1034001 - protein, 191 aa, Homo sapiens; identical to SEQ ID NO: 1033987

SEQ ID NO: 1034002 - protein, 525 aa, Homo sapiens [sequence omitted]

SEQ ID NO: 1034003 - protein, 632 aa, Homo sapiens
MNNSLENTISFEEYIRVKARSVPQHRMKEFLDSLASKGPEALQEFQQTATTTMVYQQGGNCIYTDSTEVAGSLLELACPVTTSVQPQTQQEQQIQVQQPQQVQVQVQVQQSPQQVSAQLSPQLTVHQPTEQPIQVQVQIQGQAPQSAAPSIQTPSLQSPSPSQLQAAQIQVQHVQAAQQIQAAEIPEEHIPHQQIQAQLVAGQSLAGGQQIQIQTVGALSPPPSQQGSPREGERRVGTASVLQPVKKRKVDMPITVSYAISGQPVATVLAIPQGQQQSYVSLRPDLLTVDSAHLYSATGTITSPTGETWTIPVYSAQPRGDPQQQSITHIAIPQEAYNAVHVSGSPTALAAVKLEDDKEKMVGTTSVVKNSHEEVVQTLANSLFPAQFMNGNIHIPVAVQAVAGTYQNTAQTVHIWDPQQQPQQQTPQEQTPPPQQQQQQLQVTCSAQTVQVAEVEPQSQPQPSPELLLPNSLKPEEGLEVWKNWAQTKNAELEKDAQNRLAPIGRRQLLRFQEDLISSAVAELNYGLCLMTREARNGEGEPYDPDVLYYIFLCIQKYLFENGRVDDIFSDLYYVRFTEWLHEVLKDVQPRVTPLGYVLPSHVTEEMLWECKQLGAHSPSTLLTTLMFFNTK

SEQ ID NO: 1034004 - protein, 108 aa, Homo sapiens
MNNSLENTISFEEYIRVKARSVPQHRMKEFLDSLASKGPEALQEFQQTATTTMVYQQGGNCIYTDSTEVAGSLLELACPVTTSVQPQTQQEQQIQVQQPQQVQVYGKC

SEQ ID NO: 1034005 - protein, 525 aa, Homo sapiens [sequence omitted]

SEQ ID NO: 1034006 - protein, 776 aa, Homo sapiens
MNNSLENTISFEEYIRVKARSVPQHRMKEFLDSLASKGPEALQEFQQTATTTMVYQQGGNCIYTDSTEVAGSLLELACPVTTSVQPQTQQEQQIQVQQPQQVQVQVQVQQSPQQVSAQLSPQLTVHQPTEQPIQVQVQIQGQAPQSAAPSIQTPSLQSPSPSQLQAAQIQVQHVQAAQQIQAAEIPEEHIPHQQIQAQLVAGQSLAGGQQIQIQTVGALSPPPSQQGSPREGERRVGTASVLQPVKKRKVDMPITVSYAISGQPVATVLAIPQGQQQSYVSLRPDLLTVDSAHLYSATGTITSPTGETWTIPVYSAQPRGDPQQQSITHIAIPQEAYNAVHVSGSPTALAAVKLEDDKEKMVGTTSVVKNSHEEVVQTLANSLFPAQFMNGNIHIPVAVQAVAGTYQNTAQTVHIWDPQQQPQQQTPQEQTPPPQQQQQQLQVTCSAQTVQVAEVEPQSQPQPSPELLLPNSLKPEEGLEVWKNWAQTKNAELEKDAQNRLAPIGRRQLLRFQEDLISSAVAELNYGLCLMTREARNGEGEPYDPDVLYYIFLCIQKYLFENGRVDDIFSDLYYVRFTEWLHEVLKDVQPRVTPLGYVLPSHVTEEMLWECKQLGAHSPSTLLTTLMFFNTKYFLLKTVDQHMKLAFSKVLRQTKKNPSNPKDKSTSIRYLKALGIHQTGQKVTDDMYAEQTENPENPLRCPIKLYDFYLFKCPQSVKGRNDTFYLTPEPVVAPNSPIWYSVQPISREQMGQMLTRILVIREIQEAIAVANASTMH

SEQ ID NO: 1034007 - protein, 632 aa, Homo sapiens; identical to SEQ ID NO: 1034003

SEQ ID NO: 1034008 - protein, 416 aa, Homo sapiens
MVGTTSVVKNSHEEVVQTLANSLFPAQFMNGNIHIPVAVQAVAGTYQNTAQTVHIWDPQQQPQQQTPQEQTPPPQQQQQQLQVTCSAQTVQVAEVEPQSQPQPSPELLLPNSLKPEEGLEVWKNWAQTKNAELEKDAQNRLAPIGRRQLLRFQEDLISSAVAELNYGLCLMTREARNGEGEPYDPDVLYYIFLCIQKYLFENGRVDDIFSDLYYVRFTEWLHEVLKDVQPRVTPLGYVLPSHVTEEMLWECKQLGAHSPSTLLTTLMFFNTKYFLLKTVDQHMKLAFSKVLRQTKKNPSNPKDKSTSIRYLKALGIHQTGQKVTDDMYAEQTENPENPLRCPIKLYDFYLFKCPQSVKGRNDTFYLTPEPVVAPNSPIWYSVQPISREQMGQMLTRILVIREIQEAIAVANASTMH

SEQ ID NO: 1034009 - protein, 416 aa, Homo sapiens; identical to SEQ ID NO: 1034008

SEQ ID NO: 1034010 - protein, 416 aa, Homo sapiens; identical to SEQ ID NO: 1034008

SEQ ID NO: 1034011 - protein, 416 aa, Homo sapiens; identical to SEQ ID NO: 1034008

SEQ ID NO: 1034012 - protein, 416 aa, Homo sapiens; identical to SEQ ID NO: 1034008

SEQ ID NO: 1034013 - protein, 761 aa, Homo sapiens
MNNSLENTISFEEYIRVKARSVPQHRMKEFLDSLASKGPEALQEFQQTATTTMVYQQGGNCIYTDSTEVAGSLLELACPVTTSVQPQTQQEQQIQVQQPQQVQVQVQVQQSPQQVSAQLSPQLTVHQPTEQPIQVQVQIQGQAPQSAAPSIQTPSLQSPSPSQLQAAQIQVQHVQAAQQIQAAEIPEEHIPHQQIQAQLVAGQSLAGGQQIQIQTVGALSPPPSQQGSPREGERRVGTASVLQPVKKRKVDMPITVSYAISGQPVATVLAIPQGQQQSYVSLRPDLLTVDSAHLYSATGTITSPTGETWTIPVYSAQPRGDPQQQSITHIAIPQEAYNAVHVSGSPTALAAVKLEDDKEKMVGTTSVVKNSHEEVVQTLANSLFPAQFMNGNIHIPVAVQAVAGTYQNTAQTVHIWDPQQQQQQQLQVTCSAQTVQVAEVEPQSQPQPSPELLLPNSLKPEEGLEVWKNWAQTKNAELEKDAQNRLAPIGRRQLLRFQEDLISSAVAELNYGLCLMTREARNGEGEPYDPDVLYYIFLCIQKYLFENGRVDDIFSDLYYVRFTEWLHEVLKDVQPRVTPLGYVLPSHVTEEMLWECKQLGAHSPSTLLTTLMFFNTKYFLLKTVDQHMKLAFSKVLRQTKKNPSNPKDKSTSIRYLKALGIHQTGQKVTDDMYAEQTENPENPLRCPIKLYDFYLFKCPQSVKGRNDTFYLTPEPVVAPNSPIWYSVQPISREQMGQMLTRILVIREIQEAIAVANASTMH

SEQ ID NO: 1034014 - protein, 244 aa, Homo sapiens
MNGNIHIPVAVQAVAGTYQNTAQTVHIWDPQQQPQQQTPQEQTPPPQQQQQQLQVTCSAQTVQVAEVEPQSQPQPSPELLLPNSLKPEEGLEVWKNWAQTKNAELEKDAQNRLAPIGRRQLLRFQEDLISSAVAELNYGLCLMTREARNGEGEPYDPDVLYYIFLCIQKYLFENGRVDDIFSDLYYVRFTEWLHEVLKDVQPRVTPLGYVLPSHVTEEMLWECKQLGAHSPSTLLTTLMFFNTK

SEQ ID NO: 1034015 - protein, 714 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPPPAPLTHPTSLLPQRATRTWPPRPHRASRPSLSLRSPAPWATWGASQSPWATSLTTCRIS

SEQ ID NO: 1034016 - protein, 777 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 1034017 - protein, 777 aa, Homo sapiens; identical to SEQ ID NO: 1034016

SEQ ID NO: 1034018 - protein, 816 aa, Homo sapiens
SGSSPDGSALVSPQPPPGAESARPRGPEGRGPAALPASPRPAVLPGSEPPILDPRRGRVGRRPSGVGKWGSARVRAGRQGARRPRSSAGPGHSADCLLTDDAARPSGPQGLSHEDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPPPAPLTHPTSLLPQRATRTWPPRPHRASRPSLSLRSPAPWATWGASQSPWATSLTTCRIS

SEQ ID NO: 1034019 - protein, 515 aa, Homo sapiens
GRSRGQEIKTILANMVKSRLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPPPAPLTHPTSLLPQRATRTWPPRPHRASRPSLSLRSPAPWATWGASQSPWATSLTTCRIS

SEQ ID NO: 1034020 - protein, 248 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSLS

SEQ ID NO: 1034021 - protein, 123 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILPPCPLLPVVSLLCE

SEQ ID NO: 1034022 - protein, 97 aa, Homo sapiens
AGPHPTARPWSARSLRPALSQRGPEGPRGADRPPCPPLPGPLSSRVRSRRSWTLGAAVWVGVRRALANGALRGSAQGARARGDLAPPRARGIRPIAS

SEQ ID NO: 1034023 - protein, 706 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPPPAPLTHPTRTWPPRPHRASRPSLSLRSPAPWATWGASQSPWATSLTTCRIS

SEQ ID NO: 1034024 - protein, 803 aa, Homo sapiens
AGGEEVPVEGGRPPHPAPIILSSGRPPLPKAGLKSRPDPLRLGVHLEEPGALLPSAELTPRNSTRGGGHLPWAVSGAAPPGRLSHPGSSPVRSGQGPEQLKDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPPPAPLTHPTSLLPQRATRTWPPRPHRASRPSLSLRSPAPWATWGASQSPWATSLTTCRIS

SEQ ID NO: 1034025 - protein, 714 aa, Homo sapiens; identical to SEQ ID NO: 1034015

SEQ ID NO: 1034026 - protein, 714 aa, Homo sapiens; identical to SEQ ID NO: 1034015

SEQ ID NO: 1034027 - protein, 493 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERQGRKGVGPRDHGASAQGQPGVEYLEVQRQW

SEQ ID NO: 1034028 - protein, 128 aa, Homo sapiens
VLAGYPFSERGSFLKENDKATSQLLLETDWESILQICDLIRQGDTQAKYAVNSIKKKVNDKNPHVALYALEVMESVVKNCGQTVHDEVANKQTMEELKDLLKRQVEVNVRNKILPPCPLLPVVSLLCE

SEQ ID NO: 1034029 - protein, 109 aa, Homo sapiens
AEKGGSGSRGARQLVAGERPRRRVWAGGRHGARQRHLRASPRQGDQPAPVGDRLGVHFADLRPDPPRGHTSKICCEFHQEESQRQEPTRRLVCPGGHGICGKELWPDSS

SEQ ID NO: 1034030 - protein, 150 aa, Homo sapiens
MGRGSGTFERLLDKATSQLLLETDWESILQICDLIRQGDTQAKYAVNSIKKKVNDKNPHVALYALEVKQTPVPQWPPGSLPPTSHDSMRRVCPVALPTSLGIHQAGEFPLSLECLCEQCPLGEGHAEGETGDRGGSGHHFFSRSCVSNTY

SEQ ID NO: 1034031 - protein, 777 aa, Homo sapiens; identical to SEQ ID NO: 1034016

SEQ ID NO: 1034032 - protein, 777 aa, Homo sapiens; identical to SEQ ID NO: 1034016

SEQ ID NO: 1034033 - protein, 690 aa, Homo sapiens [sequence omitted]

SEQ ID NO: 1034034 - protein, 777 aa, Homo sapiens; identical to SEQ ID NO: 1034016

SEQ ID NO: 1034035 - protein, 714 aa, Homo sapiens; identical to SEQ ID NO: 1034015

SEQ ID NO: 1034036 - protein, 414 aa, Homo sapiens
MGRGSSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPPPAPLTHPTSLLPQRATRTWPPRPHRASRPSLSLRSPAPWATWGASQSPWATSLTTCRIS

SEQ ID NO: 1034037 - protein, 263 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTEYLPTRPAVVLTGHHPELHPAAVAFLSVHPVGW

SEQ ID NO: 1034038 - protein, 256 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSRGSGAEETSTMEEDRVPVICI

SEQ ID NO: 1034039 - protein, 290 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVRVRWREGTHSHPTVLPHFGEPWAPVTLTVTCPEVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSRGSGAEETSTMEEDRVPVICI

SEQ ID NO: 1034040 - protein, 286 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSRGSGAEETCTLQPKGSVAGGPTSRPQQSPALVLGRPRCPPVPPPRPFGRVH

SEQ ID NO: 1034041 - protein, 111 aa, Homo sapiens
MPTHPSDSCCPCCGRTCQQGAWWEERLPCPNELPQQGQLDRRVYFCISTGPAHSSPKGLWPEAPRAGPSSHRLWSWAGPGAHLYPHLAHLAACTECHFAAARFFPIKVSVT

SEQ ID NO: 1034042 - protein, 149 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARAESAGPLTGGNAALRCLVCGGLRSNPCDRGKNAGE

SEQ ID NO: 1034043 - protein, 375 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYRWAGIPADGLQASRFVGHLAPHTTCHPILPSYNPDLDSDPFGEDGSLWSFNYFFYNKRLKRIVFFSCRSISGSTYTPSEAGNELDMELGEEEVEEESRSRGSGAEETSTMEEDRCVMGAMTRVPEAWSGYNRVGASSTWSKWLLKAHCVPTSAQGPSDLYLMRRSRGPSFIQLQPMPGPVHLRGPWGLPSCWPDPGAATVLALPKAIPA

SEQ ID NO: 1034044 - protein, 256 aa, Homo sapiens; identical to SEQ ID NO: 1034038

SEQ ID NO: 1034045 - protein, 309 aa, Homo sapiens
SVAALLGVWKLGNFGKSGGTCSFPLPGPESSQNERAPAQNTSPSGARSSFPKDMKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSRGSGAEETSTMEEDRVPVICI

SEQ ID NO: 1034046 - protein, 256 aa, Homo sapiens; identical to SEQ ID NO: 1034038

SEQ ID NO: 1034047 - protein, 320 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTHPSDSCCPCCGRTCQQGAWWEEQRAGHGAGGGGGGGRKQKQGQWGRGDQHHGGGQGPSDLYLMRRSRGPSFIQLQPMPGPVHLRGPWGLPSCWPDPGAATVLALPKAIPA

SEQ ID NO: 1034048 - protein, 380 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVRVRWREGTHSHPTVLPHFGEPWAPVTLTVTCPEVVNAVNCSLFSAVREDFKDLKPQLWNAVDEEICLAECDIYRWAGIPADGLQASRFVGHLAPHTTCHPILPSYNPDLDSDPFGEDGSLWSFNYFFYNKRLKRIVFFSCRSISGSTPPLLPNSRLGEYNSPVCISPVCLLNISWGREAGQGPELFLLLSDHYNLKGGRPGLTGSRAPKANGWQTPAGREAERPTRNAPSGGQRDHDVSRQKGEQVHDAHEDP

SEQ ID NO: 1034049 - protein, 256 aa, Homo sapiens; identical to SEQ ID NO: 1034038

SEQ ID NO: 1034050 - protein, 296 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAELHPASTNAWTCPPERPLGPPQLLARPWRCHSPGTAQGHTCLALWLHPVDAHSPLRLLLPMLWPDLSAGGLVGGATALPK

SEQ ID NO: 1034051 - protein, 275 aa, Homo sapiens
EEVEEESRSRGSGAEETSTMKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSRGSGAEETSTMEEDRVPVICI

SEQ ID NO: 1034052 - protein, 223 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYTAGPQSLFLYFYWACTLQPKGSVAGGPTSRPQQSPALVLGRPRCPPVPPPRPFGRVH

SEQ ID NO: 1034053 - protein, 182 aa, Homo sapiens
DGVGRPTRPVPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 1034054 - protein, 182 aa, Homo sapiens; identical to SEQ ID NO: 1034053

SEQ ID NO: 1034055 - protein, 165 aa, Homo sapiens; identical to SEQ ID NO: 771852

SEQ ID NO: 1034056 - protein, 187 aa, Homo sapiens
VDRSTAHAPSFPAPVPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 1034057 - protein, 187 aa, Homo sapiens; identical to SEQ ID NO: 1034056

SEQ ID NO: 1034058 - protein, 187 aa, Homo sapiens; identical to SEQ ID NO: 1034056

SEQ ID NO: 1034059 - protein, 187 aa, Homo sapiens; identical to SEQ ID NO: 1034056

SEQ ID NO: 1034060 - protein, 96 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPVTGYGVPSS

SEQ ID NO: 1034061 - protein, 117 aa, Homo sapiens
MQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 1034062 - protein, 187 aa, Homo sapiens; identical to SEQ ID NO: 1034056

SEQ ID NO: 1034063 - protein, 187 aa, Homo sapiens; identical to SEQ ID NO: 1034056

SEQ ID NO: 1034064 - protein, 187 aa, Homo sapiens; identical to SEQ ID NO: 1034056

SEQ ID NO: 1034065 - protein, 187 aa, Homo sapiens; identical to SEQ ID NO: 1034056

SEQ ID NO: 1034066 - protein, 187 aa, Homo sapiens; identical to SEQ ID NO: 1034056

SEQ ID NO: 1034067 - protein, 138 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADQESRGWGWVSNRIPV

SEQ ID NO: 1034068 - protein, 135 aa, Homo sapiens
RPPTTTTARIQASNDDGAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 1034069 - protein, 165 aa, Homo sapiens; identical to SEQ ID NO: 771852

SEQ ID NO: 1034070 - protein, 187 aa, Homo sapiens; identical to SEQ ID NO: 1034056

SEQ ID NO: 1034071 - protein, 187 aa, Homo sapiens; identical to SEQ ID NO: 1034056

SEQ ID NO: 1034072 - protein, 187 aa, Homo sapiens; identical to SEQ ID NO: 1034056

SEQ ID NO: 1034073 - protein, 187 aa, Homo sapiens; identical to SEQ ID NO: 1034056

SEQ ID NO: 1034074 - protein, 120 aa, Homo sapiens
MKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 1034075 - protein, 111 aa, Homo sapiens
VCINKNSLKKKKNRARRRTPRLQSQHLGRPRRVDKPRSGVRDQPGQHGKTPSPPKIQKKNLDGLPHKERLKKVKGTRQILPRLFTKNITSSITSIWIRSTKRPLDDGVGNQ

SEQ ID NO: 1034076 - protein, 163 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKGPAWFLRYPNHRHRPDGEPLGGHHLLQGH

SEQ ID NO: 1034077 - protein, 223 aa, Homo sapiens
MIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHS

SEQ ID NO: 1034078 - protein, 195 aa, Homo sapiens
MIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVR

SEQ ID NO: 1034079 - protein, 253 aa, Homo sapiens
MIKYIKDKYPNLQVIGGNVVTAAQAKNLIDAGVDALRVGMGSGSICITQEVAPKIPPDIKSHSPKCPSTVTGCYMLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 1034080 - protein, 163 aa, Homo sapiens; identical to SEQ ID NO: 1034076

SEQ ID NO: 1034081 - protein, 229 aa, Homo sapiens [sequence omitted]

SEQ ID NO: 1034082 - protein, 259 aa, Homo sapiens
MTSIGWTCSPSWCGCSGLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 1034083 - protein, 163 aa, Homo sapiens; identical to SEQ ID NO: 1034076

SEQ ID NO: 1034084 - protein, 163 aa, Homo sapiens; identical to SEQ ID NO: 1034076

SEQ ID NO: 1034085 - protein, 165 aa, Homo sapiens [sequence omitted]

SEQ ID NO: 1034086 - protein, 179 aa, Homo sapiens
MLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 1034087 - protein, 228 aa, Homo sapiens
MIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGYGRHLPSTRPR

SEQ ID NO: 1034088 - protein, 195 aa, Homo sapiens; identical to SEQ ID NO: 1034078

SEQ ID NO: 1034089 - protein, 163 aa, Homo sapiens; identical to SEQ ID NO: 1034076

SEQ ID NO: 1034090 - protein, 276 aa, Homo sapiens
MIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEALVNTSFPDGIRLKKYRGMGSLDAMDKHLSSQNRYFSEADKIKVAQGVSGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 1034091 - protein, 163 aa, Homo sapiens; identical to SEQ ID NO: 1034076

SEQ ID NO: 1034092 - protein, 163 aa, Homo sapiens; identical to SEQ ID NO: 1034076

SEQ ID NO: 1034093 - protein, 163 aa, Homo sapiens; identical to SEQ ID NO: 1034076

SEQ ID NO: 1034094 - protein, 163 aa, Homo sapiens; identical to SEQ ID NO: 1034076

SEQ ID NO: 1034095 - protein, 163 aa, Homo sapiens; identical to SEQ ID NO: 1034076

SEQ ID NO: 1034096 - protein, 514 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 1034097 - protein, 514 aa, Homo sapiens; identical to SEQ ID NO: 1034096

SEQ ID NO: 1034098 - protein, 514 aa, Homo sapiens; identical to SEQ ID NO: 1034096

SEQ ID NO: 1034099 - protein, 236 aa, Homo sapiens
MGYRRPRPSLTMKDSNPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 1034100 - protein, 514 aa, Homo sapiens; identical to SEQ ID NO: 1034096

SEQ ID NO: 1034101 - protein, 514 aa, Homo sapiens; identical to SEQ ID NO: 1034096

SEQ ID NO: 1034102 - protein, 514 aa, Homo sapiens; identical to SEQ ID NO: 1034096

SEQ ID NO: 1034103 - protein, 195 aa, Homo sapiens; identical to SEQ ID NO: 1034078

SEQ ID NO: 1034104 - protein, 163 aa, Homo sapiens; identical to SEQ ID NO: 1034076

SEQ ID NO: 1034105 - protein, 163 aa, Homo sapiens; identical to SEQ ID NO: 1034076

SEQ ID NO: 1034106 - protein, 163 aa, Homo sapiens; identical to SEQ ID NO: 1034076

SEQ ID NO: 1034107 - protein, 229 aa, Homo sapiens [sequence omitted]

SEQ ID NO: 1034108 - protein, 136 aa, Homo sapiens
RWSPALVAQAGVQWCDLSSLQPPPPRFKHLSCLSLLSSRDYRHPPPCLANFYIFSRDRASHVGQAGFELLTSSDLPALASRNIGITGVSHCAWPKFQILIAKRLFGYLTGIPNSTHPKQNPPSLPNLLFFPCFLSQ

SEQ ID NO: 1034109 - protein, 77 aa, Homo sapiens
LRCKRGAENARRKQAEGFSRVIVQIYESIGLVFPRGLSRFRVTGRVFRKPAVACNFRRYTEVTFFGKHTPVSLLEKA

SEQ ID NO: 1034110 - protein, 145 aa, Homo sapiens
PGGNVEGATQSLAEHMIQIAEESEGRSDEQMESDNCSRGDDDWTHLSSDQVDPATGDLESLTDATILMATLSAPLPRWTHRAEGSCLVPTYPAKADPQLIVSLYQMLPTGFSDEGGWLTRLLQTKNYDIGAALDTIQYSKHPPPL

SEQ ID NO: 1034111 - protein, 145 aa, Homo sapiens; identical to SEQ ID NO: 1034110

SEQ ID NO: 1034112 - protein, 122 aa, Homo sapiens
HQPQPERPLAVNPCPSSRPPPATLSVWPLCMWPAAAEATERQLRSAPRPVSWPLIGNAAAVGSAHLSFARLARPTATFSRSAWQLPHSGAECERAIPPGPGACRAAFRDRPSFASFRVVSGG

SEQ ID NO: 1034113 - protein, 200 aa, Homo sapiens
SGGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGKVHLEALKKKVIKFFYKFPLRCDIHTAQVLYVLDIQHRCCMS

SEQ ID NO: 1034114 - protein, 206 aa, Homo sapiens
SGGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGKVHLEALKKKVIKFFYKFPLRCDIHTAQVRAQVLDIQLSEASEMHACM

SEQ ID NO: 1034115 - protein, 205 aa, Homo sapiens
SGGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGKVHLEALKKKVIKFFYKFPLRCDIHTAQVLYVLDIQHRCTGLRYTAQ

SEQ ID NO: 1034116 - protein, 173 aa, Homo sapiens
SGGGGVACPRPSRLFFASAGVRGVALAARAMPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGKMKWKGTESGTGGTVYGVASSDTWN

SEQ ID NO: 1034117 - protein, 164 aa, Homo sapiens
GIGVIDEKWGGGRSEASPTLGPSLFGKGGDPEAKAQIDNLHIGVRVRVDTAAGAFPPSPRPESALRRWSEGRAPLAHFGVKRVPGISRARSFAPHLVRTSPPGRWLGWLVQPWEAMPCLKSSAYLVGCQDSASQVCGKEISNRLVISSHCVSFTPKGQKLERES

SEQ ID NO: 1034118 - protein, 164 aa, Homo sapiens
FAAASTPVNAGNQRSDTDPGIDTSADLAGPAAGSGSKSAAGAGSCPEILPGQAAILTRLQAGGHTRCAPHAIQRQGDTDPHLARQRPAKQDDRAAGDISENTVKFHLKHIFAKLSVDNRTAAISAALRLGVLDSLSLSPPAYPFGRRGRELVVVGDPGISARTW

SEQ ID NO: 1034119 - protein, 54 aa, Homo sapiens
MALQKGAETYQGDAVFAVQPPVDFFEDGVEHAAGLFFREVRFFSNCSGEFWFTH

SEQ ID NO: 1034120 - protein, 183 aa, Homo sapiens
SRRRPLRLHHIPRSTIIIQPHHNDTSNTNLNTRIDCIIFSININTTNHHNTISNSSLYFRLHHTTRSTINIRTHHSITSNIHFNITVYGTIFILRLSDNHNTGFIVCLYLPFIYTSRSNSNICFCIRHNTSSIITSPLKLHHIPRSTIIIQPHHNYTSNINLNTRIACIIFSINLNTTSTRPG

SEQ ID NO: 1034121 - protein, 113 aa, Homo sapiens
LKEQQTYRYHGHSMVTLESVTVHEKKKEDRKMPYASQGQEGEQQGGNGREEGDGGPGRAFGRAGLPHPSSVSGSSLSQSVEGRRRRGDDFRGLPDSVLRLGLKEEENPVNEIQ

SEQ ID NO: 1034122 - protein, 223 aa, Homo sapiens
RGGARSLPRSPARPGPNDALLGEDFRGQGVRARFRLSEEPGPGADGAALEVHPQALPQYGMYVWPCAVALAQYLWSHRRSLPGKAILEIGAGVTLPILAKCGAEPLPHRPLPSLEPPPQSQTPPPPPAPWHIPRPPAPPPDIPAPDVFPEPARRHKNPKVQLWSTYQVRSADWSLEALLYKWDMKCAHPPEAFDADKEDIAESTLPGSHTGEMLAIPFAKDSL

SEQ ID NO: 1034123 - protein, 90 aa, Homo sapiens
RGGARSLPRSPARPGPNDALLGEDFRGQGVRARFRLSEEPGPGAVFFFFVPQGAGVSPFAAKCGAEVILSDSVPHCEFFRCLNNSAYCRW

SEQ ID NO: 1034124 - protein, 124 aa, Homo sapiens
KTPGRTQLLNFFKLDDDRRLVDLPGYGYAKVPIPLNCTGSVTWKPIWVAGEFEGFDSDDDIRHPMTDFDLLMLDWAVASGMPMHVLLTKADKLTYSAAKNTLLKVQAEIRKGWGDAVTIQLFSA

SEQ ID NO: 1034125 - protein, 108 aa, Homo sapiens
DRYRQDLQLSRTLGRLQAEYQALASLELQEGEDDGYFRELLASINSLMKELRSGCHAETRTGRMLLVRALVGSSGDINYEEDLTCWGMSVTWAELARSLNRDMMTKKK

SEQ ID NO: 1034126 - protein, 388 aa, Homo sapiens
MPSCYGKTSEKTYYPIGPLRRHVAFLLAILDWLQQKAVGFFGTCTWVGPREYLWSLNQPKSQYPSVHKEPQPTTQKRKFSKVEINCNKLQRFPRPGFHFMFWCCMLGERRFQALARAAALTPRAAMNNFQAILTQVRMLLSSHQPSLVQALLDNLLKEDLLSREYHCTLLHEPDSEALARKISLTLLEKGDLDLALLGWARSRLQPPAAERGPGHSDHGGSSQCATMELGPLEGGYLELLNSDADPLCLYHFYDQMDLLEKKSIELYSEPDTDTINCDQFSRLLCDMEGDEETRQAYANIAELDQYVFQDSQPGGPEQGQFFIEHIGPDEVIGESNGDASRSGAEKSEEDPSQRSFRQNLKHWKPAEPPLWVTGSLLVGPVSDWSNLP

SEQ ID NO: 1034127 - protein, 86 aa, Homo sapiens
WKEISSSCECSSSLGRGGYSEDRRQQLEGPEPCHPMSTCHALLTEIVGFSLFNPLLNNVHINNSAQLCCGTNNPECSKVPHICRTG

SEQ ID NO: 1034128 - protein, 83 aa, Homo sapiens
IIQENFPNIARQANVQIQEIQRTPQRYSSRRATPRHIIVRFTKVEMKEKMLRAAREKGRVTLKGKPIRLTADLSAETLQARKS

SEQ ID NO: 1034129 - protein, 125 aa, Homo sapiens
EAKSRVHSRYGFTRKPTAMAEEGSAAEGVMDINTVLQEVVKTAFIPEGVAYEICKAAKASDKCQAHLCVLCVLASNCDEPMYVKLVEALCAEHQINLIKVDDQKLGESVGLCKTDREGKPCKVVG

SEQ ID NO: 1034130 - protein, 107 aa, Homo sapiens
RHLKGARKLEKGYQTFDIKKVVKTAFIPEGVAYEICKAAKASDKCQAHLCVLCVLASNCDEPMYVKLVEALCAEHQINLIKVDDQKLGESVGLCKTDREGKPCKVVG

SEQ ID NO: 1034131 - protein, 162 aa, Homo sapiens
MKEPLDGECGKAVVPQQELLDKIKEEPDNAQEYGCVQQPKTQESKSKMVVCLQLMRDLCPAVEPRLSAFFRIIWPKCVASFSSSCAIKVPVTLVTKSPSTGQTHIIRPGSTHALLHHTMHQPDILHTAACNSSKNPAQRPKHQPHHPLTHLPHRPPAPHTRP

SEQ ID NO: 1034132 - protein, 154 aa, Homo sapiens
YYYYIRGSSTTGDDRRRTHDMNTANWIPDLFMKRVFDDGPWTLFSPSEVPDLHDLTGKAFEERYEYYEALSQYPGKIKLFKTIQAKDLWRKMLSMLFETGHPWLTFKDPCNLRSPQQHVGVVHSSNLYTEITLNTNKDEIAVCNLGSINLRRRG

SEQ ID NO: 1034133 - protein, 172 aa, Homo sapiens
LLLLQKKRPLRHLAVVTDLGNDLDDPILRQFQVLAVLAVGTNRQATSEFLVDLASSRTFYEVITASSVLSSAYRPNERSWSTLRRRYAPLGPEDPWRWFQAEPRSPSARQLAALGNSWDLSRSVRRNDRIPATWALSSEVSKVIGVYFRPLERKKSDTFSSVVVPAWMQMVA

SEQ ID NO: 1034134 - protein, 122 aa, Homo sapiens
MRLLSPLLSRSLGFPGVAGIRAFAQWGLAAGSPGRDCVPATCPVATWPCGRPRPCEMWQAGTSGAWVSWKCFCHSGRRWRQLGCPHKGPIRDTRKAILNLSAHVTSMWPGHSSFRHQSAGGR

SEQ ID NO: 1034135 - protein, 139 aa, Homo sapiens
MHPFQQTFHFGVRPDFLALQGAPASSCIPCPGPGISPFSKEPRVLLLASLKRVRPGCQAGSPRSFYWEVLESEAWVPGGCQVGPVLLGCCHVEALSCRAGTRVSPVQLQSRDEGVTCVYEHLRSHFCICEENMSSCYCL

SEQ ID NO: 1034136 - protein, 80 aa, Homo sapiens
PEHLPLQTQFKEREVGNLQHSNGLNSRSFDYEDENPVGEDGIQQMYPLYNQMCYQDRSPGKHHQNNDPKRVYIDPREHYV

SEQ ID NO: 1034137 - protein, 272 aa, Homo sapiens
RLPVSSRLALFSFQSKGTGVSLGARGPVNAVKPGRALAAWQAWVPHLPLHAVHPVDATLALLSLVALGSPGALLPTAPFFSLHSLVPNRSEVPGSSRISGFSLLSWEPRLASFSLKAGVAPEPRRSSCRLAFEGAAHLLHVIFDHVHDGVDGLADGLLCVAALAPVSRREVAPVRVVRGDDAQTRLQVVGCDGHREDFDAQVLGLVHSILQPPTGFLVALQGVPVGHHNQVLILLQVGAPHEELLQPLLDSAVGVGALPKVLDRVHAAFEVR

SEQ ID NO: 1034138 - protein, 153 aa, Homo sapiens
SGSQDGQLLDLHHRLYWSLGLWTEAGTTSSALLDLQLGNCRPWDISDSIIMTQAVAAVFQASCLHNPMALFFSAATETDCLPPANLKFGKPASSASQNQTGARRTSDPSVDHLSSCTSLCTLCSGNAFGVLLTSVPAPSLTTLHFTLSHTGFT

SEQ ID NO: 1034139 - protein, 119 aa, Homo sapiens
KWPTVLRTLTSRAGVRTWEPAGPARQPRCRAAAPSRRVACGVWSARCDVCTMTKSPNDAFLRTRLVVTHDCTLCGFGQPQLKHGDRDTYASGAGTAGRVGTLAAASSACQGQQQGLAKG

SEQ ID NO: 1034140 - protein, 99 aa, Homo sapiens
VIQETQWRPSNEWHGCQDANWDTKALAVGAAQQGWPLEIRDANSSSIIAKEDQQRPTEAMSRIQLQQQAVDLLQRLKPTLLPSDPPLTSLPCCHPNTCH

SEQ ID NO: 1034141 - protein, 114 aa, Homo sapiens
LGAFFPLPSLQPGSEAVVNSTALKWECRWGSSLKYSHVLAALASMEIKAEVPEEPFIHHLSHRKKLLRRSSLLKTSFIPHLIGTDSPAGTKPSSGVGKEQLPSRASGARRRNGQ

SEQ ID NO: 1034142 - protein, 262 aa, Homo sapiens
MADMQNLVERLERAVGRLEAVSHTSDMHRGYADSPSKGAAPYVQAFDSLLAGPVAEYLKISKEIGGDVQKHAEMVHTGLKLERALLVTASQCQQPAENKLFRLVGTHLRARSTEVITFREKNRGSKLFNHLSAVSESIQALGWVAMAPKPGPYVTEMNDAAMFYTNRVLKEYKDVDKKHVDWVKAYLSIWTELQAYIKEFHTTGLAWSKTGPVAKELSGLPSGPSAGSGPPPPPPGPPRSPSLYQVQGSDESASRSATVRAD

SEQ ID NO: 1034143 - protein, 296 aa, Homo sapiens
MADMQNLVERLERAVGRLEAVSHTSDMHRGYADSPSKGAAPYVQAFDSLLAGPVAEYLKISKEIGGDVQKHAEMVHTGLKLERALLVTASQCQQPAENKLFPGIFWVLGAKSPPPKMFPFPRGKGAQRGKFFQRHREQHGFGNVKTPFSGGNERNREAAKLFNHLSAVSESIQALGWVAMAPKPGPYVTEMNDAAMFYTNRVLKEYKDVDKKHVDWVKAYLSIWTELQAYIKEFHTTGLAWSKTGPVAKELSGLPSGPSAGSGPPPPPPGPPRSPSLYQFHGSDESASRSDTVRAD

SEQ ID NO: 1034144 - protein, 232 aa, Homo sapiens
WARRGLVWQMWIAGPSWVPLRYVVLVDAFGENLCSPQLQGQHAFLASSDQGGCSCGAAPKLQQWAFFKVSCKMESEAHPSVRVSSWYPWNLLVCLTLAFDPGRGSNIYIGHSDSLAFGSLPYTGLPDVDLLHFTVIRKSLSPQKWPAHLIPAKTQVRVLTVLPSFLRVSVGCAESGPRCVRGCVHCHRSLYTSRRGPRAELGPRGPSRRAAMDPGLSCDHEGYPDELPWTQG

SEQ ID NO: 1034145 - protein, 189 aa, Homo sapiens
WARRGLVWQMWIAGPSWVPLRYVVLVDAFGENLCSPQLQGQHAFLASSDQGGCSCGAAPKLQQWAFFKWPAHLIPAKTQVRVLTVLPSFLRVSVGCAESGPRCVRGCVHCHRSLYTSRRGPRAELGPRGPSRRAAMDPGLSCDHEGYPDELAVDPGLSRDHEGHPETVIVFWYVGDVPEPGLSCDHEGK

SEQ ID NO: 1034146 - protein, 233 aa, Homo sapiens
MLCPCIQESTFETCLFMAVSRMSKWRLSRVGGSRSLPAEMEVLGEVWCVRAEEQPMTGLGIVWHSPLLDKALETWSLQQQPDFSLGLGHLGLGTDATWMQSFPGSGGDAQAGTGVSGPLRLYPNLLCDFGPRQGPLWALLLEKRQMAGTGGPQPSLPGGLRVGGLWGKARAGPGESLGSSLVNRVPSSQSRGKARHMPLIWELGLTPSPSPAHLEHVALAHLPCGWTLSSPGS

SEQ ID NO: 1034147 - protein, 118 aa, Homo sapiens
FETGCCSIAQAEVQWWDDNSLQPQLPGLNRSFHRVGPQPSLPGGLRVGGLWGKARAGPGESLGSSLVNRVPSSQSRGKARHMPLIWELGLTPSPSPAHLEHVALAHLPCGWTLSSPGS

SEQ ID NO: 1034148 - protein, 233 aa, Homo sapiens; identical to SEQ ID NO: 1034146

SEQ ID NO: 1034149 - protein, 54 aa, Homo sapiens
MHALRVLDGLCHDPVGRNGIQRRVRGQTAGWASPYITQFLLEVILPAATGSLRY

SEQ ID NO: 1034150 - protein, 102 aa, Homo sapiens
FERVFRHKQNCVEFYPIFIITLWMAGWYFNQVFATCLGLVYIYGRHLYFWGYSEAAKKRITGFRLSLGILALLTLLGALGIGNSFLDEYLDLNIAKKLRREC

SEQ ID NO: 1034151 - protein, 130 aa, Homo sapiens
EPVGEVEKLMLFVAEWVVRAIVRCSRMRLVSWHGVQVVGVVGGDGGRQDACLEGGAHRVMLVQQLLQRADVLDRERSVSTLLIFLLAAPLGTCSRRVAKPRLTNLTRLRSRSLRRATAAGCCCGSCSQSR

SEQ ID NO: 1034152 - protein, 186 aa, Homo sapiens
EPVGEVEKLMLFVAEWVVRAIVRCSRMRLVSWHGVQVVGVVGGDGGRQDACLEGGAHRVMLVQQLLQRADVLDRERSVSTLLIFLLAAPLGTCSRRVAKPRLTNLTRLRSRSLRAPRRPAAAAAAVAKAAEVEPAFAAHQFGRRRVPSIEQFGLVTLRASSEDVAVALRFQLWRLVIVPLNKVVLR

SEQ ID NO: 1034153 - protein, 200 aa, Homo sapiens
EPVGEVEKLMLFVAEWVVRAIVRCSRMRLVSWHGVQVVGVVGGDGGRQDACLEGGAHRVMLVQQLLQRADVLDRERSVSTLLIFLLAAPLGTCSRRVAKPRLTNLTRLRSRSLRAPRRPAAAAAAVAKAAEVEPAFAAHQFGRRRAAVRFDLCYVVLYISATASTDGSEPVWPAGSHAASVLLPACWLLCVLLANNMRRC

SEQ ID NO: 1034154 - protein, 103 aa, Homo sapiens
TVGCGINFNENAIHKEGCVEKIGGWLGKNVLVVAAAALGIAFVEVLGIVFACCLVKSSRSGYEVDVGVWSRQRPHLGEWGSILRGVRVNGLLCQGEKRGADGV

SEQ ID NO: 1034155 - protein, 118 aa, Homo sapiens
MLPNKQTNKKSPPVRCRDLIETVVGALAFFQAGGDPHPWQPDREAEEARAPGDSREGGGPGGQAPSPTPPQDPGAGLSPAFAPMGMRERRWVREQLWPLGKVTWMQPLKEMLPVNPIG

SEQ ID NO: 1034156 - protein, 82 aa, Homo sapiens
LLQTLRVFISLILKSCVPAKGIRLGNRGFLLARRSLFQRKPDLPSHPTAPPSETSGSLPPSPRGRRKNSSPGPIPGWVGSLE

SEQ ID NO: 1034157 - protein, 426 aa, Homo sapiens
GRKILTLVVGESKVELWLHSQASSPSVGSLVLLLAIAMPCWLLAQGHQGPIGRGVTSCRSAGSSHRVPTTANSSSSGSKNLVQGATLELQGVSTPVPRRAQEHASSTAASPSSSSTSVGFFFRIFSGYLHSDKLKVFGPLIMGIGIFLFICANAVLHENRDKKTKIINLRDLYSTVIDVHSLRAKDLAAAAAAAAAAAASSSSSAPAAAPPGAIPLNGFLSYVQSRGLELKPGGCGGSGDAFGAAAMLAKGSWPPHPAAPSGGRPRGAASPPDLASSPRCPREPPSLAEAVYSVYRERSGVAGSRRAAAATAAAAASSCSSPAPCSPPESWGRQSTASSFVDSSLSAFALLPLQGGRDRGGDAEGASCSWQRPPGERGSQEIPRGELDLSMTNLRGAVGSMRGARREPEEPEGAVAARAARGQGGR

SEQ ID NO: 1034158 - protein, 200 aa, Homo sapiens
CDWWNSGEILLEFCWNTLFLVNTHLGTPSEGYQLANISSHSTTVKLSPEASDLIIKLCRGPEDRLGKNGADEIKAHPIFLKQFDFSSDLRQQSASYIPKITHPTDTSNFDPVDPDKLWSDDNEEENVNDTLNGWYKNGKHPEHAFYEFTFRRFFDDNGYPYNYPKPIEYEYINSQGSEQQSDEDDQNTGSEIKNRDLVYV

SEQ ID NO: 1034159 - protein, 410 aa, Homo sapiens
METSSPRPPRPSSNPGLSLDARLGVDTRLWAKVLFTALYALIWALGAAGNALSVHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 1034160 - protein, 410 aa, Homo sapiens; identical to SEQ ID NO: 1034159

SEQ ID NO: 1034161 - protein, 384 aa, Homo sapiens
METSSPRPPRPSSNPGLSLDARLGVDTRLWAKVLFTALYALIWALGAAGNALSVHVVLKARAGRAGRLRHHVLSLALAGLLLLLVGVPVELYSFVWFHYPWVFGDLGCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 1034162 - protein, 246 aa, Homo sapiens
MDPGDPAGDPAAGERHRMGRDPLLLLQALQTLWSTRERKQLREEAWRGFAALDDPLAGLLDMLESCRGQRGEGPSLAAWISHQLQCWLQAQPCPSLAQHSLRLKQLQARAVKVLTESPPSLAAPLASIFQLQDADRSCLLAHVHRLHHEGRFREAATLGATLKLQSELGVEKMSIPLLLQDKVALVERYVAGFPDLQRRLLVLMDSWCQPGFDIKDVASCHVTAAGAAASGEERLGLAGAQPSSPE

SEQ ID NO: 1034163 - protein, 332 aa, Homo sapiens
MDPGDPAGDPAAGERHRMGRDPLLLLQALQTLWSTRERKQLREEAWRGFAALDDPLAGLLDMLESCRGQRGEGPSLAAWISHQLQCWLQAQPCPSLAQHSLRLKQLQARAVKVLTESPPSLAAPLASIFQLQDADRSCLLAHVHRLHHEGRFREAATLGATLKLQSELGVEKMSIPLLLQDKVALVERYVAGFPDLQRRLLVLMDSWCQPGFDIKDVARQYPEVTSLSLEKLSPKALSRQVLRLQERYGVPQRCVPTRPFSSAWRPCGTCATSGFVGEEPVTGELDRPCADGSVRATRTNPACLWGRVGAESHREVQAPGRGKRKAGPPPRA

SEQ ID NO: 1034164 - protein, 252 aa, Homo sapiens
MFSKCNTPASRAPGTASAPPGTLMALPGTDTAPPPRTASVPPGTASAPPGTLMALPGTDTAPPPRTASVPPGTASAPPGTLMALPGTDTAPRQNRHGARWNTNGPPWNSLGAPWNTNGPPWNRHGAPPQNSLDAPWNSLGAPWNSLGAPWNSLVLLEQTQPPQNRHSTPWNSLALPGMATSPHPFCAALGICPYVVRVQLCQQGQLHKRPQLSPPQWAPLLRLWVSFFPGGVLAPVLAPPRCLDTCPCHPGH

SEQ ID NO: 1034165 - protein, 219 aa, Homo sapiens
MDPGDPAGDPAAGERHRMGRDPLLLLQALQTLWSTRERKQLREEAWRGFAALDDPLAGLLDMLESCRGQRGEGPSLAAWISHQLQCWLQAQPCPSLAQHSLRLKQLQARAVKVLTESPPSLAAPLASIFQLQDADRSCLLAHVHRLHHEGRFREAATLGATLKLQSELGVEKMSIPLLLQDKVALVERYVAGFPDLQRRLLVLMDSWCQPGFDIKDVAR

SEQ ID NO: 1034166 - protein, 36 aa, Homo sapiens
MGVGREDTGPLKGAHGSIVFYFKQHTKIQKAIVQIK

SEQ ID NO: 1034167 - protein, 97 aa, Homo sapiens
ANEQEDGRSQRRGRSSGSGQGDEQVGLGCKIMPIADILIPSSGLLHVSLSLAQAGPSEMLCSGRCFWSGVSSSPPYPQVLLRQPTEVATIKDPVLHL

SEQ ID NO: 1034168 - protein, 81 aa, Homo sapiens
LDSNASGMENHPQCCRATSFSIIYPPGFRRKNFVPSAIFTGQGLALPPHSQHTALCILQFLKSGNSPVVLESNLPLSTIFV

SEQ ID NO: 1034169 - protein, 83 aa, Homo sapiens
YLSAPEEFEPLRTDEGPGTYPGSTKKIKQTPQIDYTRGSIISQCRRAPYWTWRKHSGFQNFAIQNSPFSGFICFCVSWEKMML

SEQ ID NO: 1034170 - protein, 83 aa, Homo sapiens; identical to SEQ ID NO: 1034169

SEQ ID NO: 1034171 - protein, 96 aa, Homo sapiens
ERVPCRHDDVFFPPSASFRVGSALALAPGVRSISALGRTFTRDEDLAVLPRPPGPYASTGRALSAGPEDCADPSGCVCGNAERSRGSAGPAPPLGG

SEQ ID NO: 1034172 - protein, 113 aa, Homo sapiens
STSKALGPPGAFNGNCETKLSVVPKGLGLEGSQEQPPGPDPLVGPFPPKEPPPPPVPGPPVSPPAPRPATPSLPPPPQPQPFLSPPPNSVFKLFKLWLGSGRVQGALGPGFVF

SEQ ID NO: 1034173 - protein, 184 aa, Homo sapiens
EDLTDLHTIEGPEGPQMLEVFPHTPAGEGLPRLPTPGPPPEPDPPPERGGQHGETCANVPKRDWTAELGTRHVLLTIKCPPDPTLTPSLHSTRRRAACSWRTTRSMQLGPVCSQRSTGAPAGPTAGPKTGRALASGTEASSTDPGAPGGPGGAEGPMAKKHAGEPDKKLAAQKKTDKKRALRRL

SEQ ID NO: 1034174 - protein, 90 aa, Homo sapiens
TPPTLPLTGPYMERNSTAPADRLPCEARPTPAHPPGSPSPAPALPPGRHLFAGTELTDLAVGCILLAGSLLVLCGCLVLIVKLLNSVLRG

SEQ ID NO: 1034175 - protein, 352 aa, Homo sapiens
MPSSLPGSQVPHPTLDAVDLVEKTLRNEGTSSSAPVLEEGDTDPWTLPQLKDTSQPWKELRVAGRLRRVAGSVLKACGLLGSLYFFICSLDVLSSAFQLLGSKVAGDIFKDNVVLSNPVAGLVIGVLVTALVQSSSTSSSIVVSMVAAKLLTVRVSVPIIMGVNVGTSITSTLVSMAQSGDRDEFQRAFSGSAVHGIFNWLTVLVLLPLESATALLERLSELALGAASLTPRAQAPDILKVLTKPLTHLIVQLDSDMIMSSATGNATNSSLIKHWCGTTGQPTQENSSCGAFGPCTEKNSTAPADRLPCRHLFAGTELTDLAVGCILLAGSLLVLCGCLVLIVKLLNSVLRG

SEQ ID NO: 1034176 - protein, 352 aa, Homo sapiens; identical to SEQ ID NO: 1034175

SEQ ID NO: 1034177 - protein, 69 aa, Homo sapiens
PSPRPIADIATVKGRKPEAHSQEQGHPQTGCECEDGPDGEEMDPPNPEEVKTPEEGEKQITVLKEDTLK

SEQ ID NO: 1034178 - protein, 144 aa, Homo sapiens
TWCSRTISPRPLHPCWRLDQAQQRARILLFRPPQSAADAVQGLDSNPLPSFCLGPVSWGGTRMNWSAAYAIALDRTFATGRAGLCPMCPVTPLSMCVGVAHVQVCPLCRDLGFNVFCCPALLCCGELAARGKGCEPAAIKLTST

SEQ ID NO: 1034179 - protein, 145 aa, Homo sapiens
ASGPRRGVQEGDGEWGGSAIRALDAPVLAPPNLDLAGNLPQRNSECRRPPPPPVPLRVPPPAESQALLPSPTSAAGQERAGEGDSVKRGPGEGRGRRTRGGEEGAGGAGAPGAPVPSAKAASARDSKTSVMCHSPLLADCSWIKD

SEQ ID NO: 1034180 - protein, 66 aa, Homo sapiens
HLQKHLAGLGLTEAIDKNKRSGKKFYLAFHATAFELTDGNPFDQDIYGREGGAAPSCSTPTTPSSS

SEQ ID NO: 1034181 - protein, 207 aa, Homo sapiens
MAEVGGVFASLDWDLHGFSSSLGNVPLADSPGFLNERLGQIEGKLQRGSPTDFAHLKGILRRRQLYCRTGFHLEIFPNGTVHGTRHDHSRFGILEFISLAVGLISIRGVDSGLYLGMNERGELYGSKKLTRECVFREQFEENWYNTYASTLYKHSDSERQYYVALNKDGSPREGYRTKRHQKFTHFLPRPVDPSKLPSMSRDLFHYR

SEQ ID NO: 1034182 - protein, 770 aa, Homo sapiens
MEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLADGPAPADAPREPCSAQDPHPQVSTASSTLGPHSPEPLGVCRNPPPPCSPMLEASDDEALLVC

SEQ ID NO: 1034183 - protein, 31 aa, Homo sapiens
ASTKPDIYLFMCSASGGTDTQYFGPGTRLTV

SEQ ID NO: 1034184 - protein, 671 aa, Homo sapiens
MASVALEDVAVNFTREEWALLGPCQKNLYKDVMQETIRNLDCVVMKWKDQNIEDQYRYPRKNLRCRMLERFIESKDGTQCGETSSQIQDSIVTKNTLPGVGPCESSMRGEKVMGHSSLNCYIRVGAGHKPHEYHECGEKPDTHKQRGKAFSYHNSFQTHERLHTGKKPYDCKECGKSFSSLGNLQRHMAVQRGDGPYKCKLCGKAFFWPSLLHMHERTHTGEKPYECKQCSKAFSFYSSYLRHERTHTGEKPYECKQCSKAFPFYSSYLRHERTHTGEKPYKCKQCSKAFPDSSSCLIHERTHTGEKPYTCKQCGKAFSVSGSLQRHETTHSAEKPYACQQCGKAFHHLGSFQRHMIRHTGNGPHKCKICGKGFDCPSSLQSHERTHTGEKPYECKQCGKALSHRSSFRSHMIMHTGDGPHKCKVCGKAFVYPSVFQRHERTHTAEKPYKCKQCGKAYRISSSLRRHETTHTGEKPYKCTLGKAFIDFCSFQNHKTTHTGEKPYECKECGKAFSRFRYLSRHKRTHTGEKPYECKTCRKAFGHYDNLKVHERIHSGEKPYECKECGKAFSWLTCFLRHERIHMREKSYECPQCGKAFTHSRFLQGHEKTHTGENPYECKECGKAFASLSSLHRHKKTHWKKTHTGENPYECKECGKAFASLSSLHRHKKTH

SEQ ID NO: 1034185 - protein, 479 aa, Homo sapiens
MEKGLTLPQDCRDFVHSLKMRSKYALFLVFVVIVFVFIEKENKIISRVSDKLKQIPQALADANSTDPALILAENASLLSLSELDSAFSQLQSRLRNLSLQLGVEPAMEAAGEEEEEQRKEEEPPRPAVAGPRRHVLLMATTRTGSSFVGEFFNQQGNIFYLFEPLWHIERTVSFEPGGANAAGSALVYRDVLKQLFLCDLYVLEHFITPLPEDHLTQFMFRRGSSRSLCEDPVCTPFVKKVFEKYHCKNRRCGPLNVTLAAEACRRKEHMALKAVRIRQLEFLQPLAEDPRLDLRVIQLVRDPRAVLASRMVAFAGKYKTWKKWLDDEGQDGLREEEVQRLRGNCESIRLSAELGLRQPAWLRGRYMLVRYEDVARGPLQKAREMYPFAGIPLTPQVEDWIQKNTQAAHDGSGIYSTQKNSSEQFEKWRFSMPFKLAQVVQAPCGPAMRLFGYKLARDAAALTNRSVSLLEERGTFWVT

SEQ ID NO: 1034186 - protein, 1099 aa, Homo sapiens
MATVPVYCVCRLPYDVTRFMIECDACKDWFHGSCVGVEEEEAPDIDIYHCPNCEKTHGKSTLKKKRTWHKHGPGPTPDVKPVQNGSQLFIKELRSRTFPSAEDVVSRVPGSQLTVGYMEEHGFTEPILVPKKDGLGLAVPAPTFYVSDVENYVGPERSVDVTDVTKQKDCKMKLKEFVDYYYSTNRKRVLNVTNLEFSDTRMSSFVEPPDIVKKLSWVENYWPDDALLAKPKVTKYCLICVKDSYTDFHIDSGGASAWYHVLKGEKTFYLIRPASANISLYERWRSASNHSEMFFADQVDKCYKCIVKQGQTLFIPSGWIYATLTPVDCLAFAGHFLHSLSVEMQMRAYEVERRLKLGSLTQFPNFETACWYMGKHLLEAFKGSHKSGKQLPPHLVQGAKILNGAFRSWTKKQALAEHEDELPEHFKPSQLIKDLAKEIRLSENASKAVRPEVNTVASSDEVCDGDREKEEPPSPIEATPPQSLLEKVSKKKTPKTVKMPKPSKIPKPPKPPKPPRPPKTLKLKDGGKKKGKKSRESASPTIPNLDLLEAHTKEALTKMEPPKKGKATKSVLSVPNKDVVHMQNDVERLEIREQTKSKSEAKWKYKNSKPDSLLKMEEEQRLEKSPLAGNKDKFSFSFSNRKLLGSKALRPPSSPGVFGALQSFKEDKAKPVRDEYEYVSDDGELKIDEFPIRRKKSAPKRDLSFLLDKKEALLMPTSKPKLDSAVYKSDDSSDEGSLHIDTDTKPGRNAKVKKESGSSAAGILDLLQASEEVGALEYNPNSQPPASPSTQEAIQGMLSMANLQASDSCLQTTWGTGQAKGGSLAAHGARKIGGGNKGTGKRLLKRTAKNSVDLEDYEEQDHLDACFKDSDYVYPSLESDEDNPVFKSRSKKRKGSDDAPYSPTARVGPSVPRQDRPVREGTRVASIETGLAAAAAKLSQQEEQKNRKKKNTKRKPAPNTASPSISTSASASTGTTSASTTPASTTPASTTPASTTPASTSTASSQASQEGSSPEPPPESHSSSLADHEYTAAGTFSGSQAGRASQPMAPGVFLTQRRPSASSPNNTAAKGKRTKKGMATAKQRLGKILKIHRNGKLLL

SEQ ID NO: 1034187 - protein, 1098 aa, Homo sapiens
MATVPVYCVCRLPYDVTRFMIECDACKDWFHGSCVGVEEEEAPDIDIYHCPNCEKTHGKSTLKKKRTWHKHGPGPTPDVKPVQNGSQLFIKELRSRTFPSAEDVVSRVPGSQLTVGYMEEHGFTEPILVPKKDGLGLAVPAPTFYVSDVENYVGPERSVDVTDVTKQKDCKMKLKEFVDYYYSTNRKRVLNVTNLEFSDTRMSSFVEPPDIVKKLSWVENYWPDDALLAKPKVTKYCLICVKDSYTDFHIDSGGASAWYHVLKGEKTFYLIRPASANISLYERWRSASNHSEMFFADQVDKCYKCIVKQGQTLFIPSGWIYATLTPVDCLAFAGHFLHSLSVEMQMRAYEVERRLKLGSLTQFPNFETACWYMGKHLLEAFKGSHKSGKQLPPHLVQGAKILNGAFRSWTKKQALAEHEDELPEHFKPSQLIKDLAKEIRLSENASKAVRPEVNTVASSDEVCDGDREKEEPPSPIEATPPQSLLEKVSKKKTPKTVKMPKPSKIPKPPKPPKPPRPPKTLKLKDGGKKKGKKSRESASPTIPNLDLLEAHTKEALTKMEPPKKGKATKSVLSVPNKDVVHMQNDVERLEIREQTKSKSEAKWKYKNSKPDSLLKMEEEQRLEKSPLAGNKDKFSFSFSNRKLLGSKALRPPSSPGVFGALQSFKEDKAKPVRDEYEYVSDDGELKIDEFPIRRKKSAPKRDLSFLLDKKEALLMPTSKPKLDSAVYKSDDSSDEGSLHIDTDTKPGRNAKVKKESGSSAAGILDLLQASEEVGALEYNPNSQPPASPSTQEAIQGMLSMANLQASDSCLQTTWGTGQAKGGSLAAHGARKIGGGNKGTGKRLLKRTAKNSVDLEDYEEQDHLDACFKDSDYVYPSLESDEDNPVFKSRSKKRKGSDDAPYSPTARVGPSVPRQDRPVREGTRVASIETGLAAAAAKLSQQEEQKSKKKKSAKRKLTPNTTSPSTSTSISAGTTSASTTPASTTPASTTPASTTPASTSTASSQASQEGSSPEPPPESHSSSLADHEYTAAGTFTGVPGWPYLPAHGPWGLSHTEAAFRIVSKQTPLPKENVRKRAWRPPSRGLGKILKIHRNGKLLL

SEQ ID NO: 1034188 - protein, 295 aa, Homo sapiens
AGGGGRVAPNQEGWTGCGLQLEGAGPSFPTARVGPSVPRQDRPVREGTRVASIETGLAAAAAKLSQQEEQKSKKKKSAKRKLTPNTTSPSTSTSISAGTTSASTTPASTTPASTTPASTTPASTSTASSQASQEGSSPEPPPESHSSSLADHEYTAAGTFTGAQAGRTSQPMAPGVFLTQRRPSASSPNKHRCQRKTYEKGHGDRQAEAWENFENSSERETTPLRFGKPGSFCSAQDPRSPAKTSGSQEGAELAQPGRALPLPGGILPNKRLCLQRASEPSVAPQFENGRLFSSC

SEQ ID NO: 1034189 - protein, 31 aa, Homo sapiens
MLAGMVSISCPRDLPASGSQSAGITGVSHGP

SEQ ID NO: 1034190 - protein, 57 aa, Homo sapiens
MGTAVGPHHSPAPHDSALPARLLTSDFPYGRSCQIEQVKYSVPDTGLFQHWEGSIPT

SEQ ID NO: 1034191 - protein, 1026 aa, Homo sapiens
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 1034192 - protein, 977 aa, Homo sapiens
GTRAPSRPRAPAQAMMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 1034193 - protein, 308 aa, Homo sapiens
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFREEGTCCRKAQRIQS

SEQ ID NO: 1034194 - protein, 1048 aa, Homo sapiens
MSNKTGGKRPATTNSDIPNHNMVSEVPPERPSVRATRTARKAIAFGKRSHSMKRNPNAPVTKAGWLFKQASSGVKQWNKRWFVLVDRCLFYYKDEKEESILGSIPLLSFRVAAVQPSDNISRKHTFKAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKVGVVPPRTKSPTDDEVTPSAVVRRNASGLTNGLSSQERPKSAVFPGEGKVKMSVEEQIDRMRRHQSGSMKEKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSVQCATPSPPTSPASPAPPANPLSSESPRGADSSYTMRV

SEQ ID NO: 1034195 - protein, 1048 aa, Homo sapiens; identical to SEQ ID NO: 1034194

SEQ ID NO: 1034196 - protein, 1111 aa, Homo sapiens
MHLNLHIGILSPKDGPGCPSQKLLHPRGKLPWMTGFCMMETIIAIAANSMSCEDPNQLSCNICNSVVGRGCVSKDGAEITAFKVSAVQNEEAPELAVLTEKEEKTGWACLGSEASSKPYPKLQFHGKAQTFNAIFNLMVERFTLFSGAAQPVPSAMDVTGYLRKRRGENPFFHSNCPDPKGILGSLVTMDTTMNFIWILSRLILEASCYDFLFLFLGSTTLYSQLLLHLGQVSNCFPPESVFPSSEVVLKPGFPSGAWDPVYSCTSGPLTVGIDHSHEGITVIWQLQKAEPPHGAITPWDTHPDFSEAENLSSPLTALEFMARSKSTAFSPTYVLLLGGDYWDPSEKKHWVPELNSQPPGTFRRIQPNTGICAIIFLSSPPTPSLTTVVYGNDMNSISNVNQWGEPQLQERFLAESLNFWMKKTNKFCPMYLFLRPCLGTKNKILGHWRLMWDLMSACVCVCVCVCVSLSHTHKSSLLLLFPPSEASKYFLKSMLCGSSTVLISVFVSILKYPCLFHVNHWEGRGWQGRQICYKSMGRPYNEMFIGWYTVLSLELPTFQLIYPYSLSTKDKIEGFFFSLNVLPSGFPGLQDYSVPNLTISSLLLSETRVTLLRGITPYSGLRSNYFLKYSKKSRKREMVACCFSQTPHILTWDGIHIETLHLGKICLTEGDSVLQIKVKKISAGDLKNSLLPLFGEGGGIILITHLTQGISAEVTQITKLQFLIILYFCFPYSLALTKLKLRSRLHKPDPCDGMEKWAFAEGLLIEMDYYSQVLAHGSTEKAIVKNDLMNTVPQRPKPEDIAPYNPISLIFEEVLNQPDYGYMGPPGCMGACLLSLALEVSTAGPDPGKGGSNPEDVALKGGTYQNAKAAGTRRRLKIQPMYTRSFQFDGLVILLHDYTMEKFSVTRVVMEVSECSPGFSFLKAVVRKVWHKTSSISSLWELVRNENSQSHPRSAESETLMRGPGNPRFNEALLVILMHTKFNCFKGKALYSIGVPTLRGFGAQNKKVLGCHSDFNINFKVTFLMLPCVSVFPFMILTKKGMCAFGWKLGECLCLSYLNTTFREKPYALEITTWHTKGLQQGKAVGGLFQIALLPNYLYLFRADYVIGWKK

SEQ ID NO: 1034197 - protein, 1595 aa, Homo sapiens
MVPFGFPEFFRCDPAISPSLHAAAQISRGEFVRISGLDYVDSALLMGRDRDKPFKRRLKSESVETSLFRKLRTVKSEHETFKFTSELEESRLERGIRPWNCQRCFAHYDVQSILFNINEAMATRANVGKRKNITTGASAASQTQMPTGQTGNCESPLGSKEDLNSKENLDADEGDGKSNDLVLSCPYFRNETGGEGDRRIALSRANSSSFSSGESCSFESSLSSHCTNAGVSVLEVPRENQPIHREKVKRYIIEHIDLGAYYYRKFFYGKEHQNYFGIDENLGPVAVSIRREKVEDAKEKEGSQFNYRVAFRTSELTTLRGAILEDAIPSTARHGTARGLPLKEVLEYVIPELSIQCLRQASNSPKVSEQLLKLDEQGLSFQHKIGILYCKAGQSTEEEMYNNETAGPAFEEFLDLLGQRVRLKGFSKYRAQLDNKTDSTGTHSLYTTYKDYELMFHVSTLLPYMPNNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYEEKEKCVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHQGAQLLPCSPSLELPPSPDTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASAISAGSAAEGSMGDLSETILSFQWFITIQEALQLTVQKVDGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEGLDSDEELGLLCHHTSYLDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKSSANPHLIKGPLGNAPCPFEVTNMWFFCVLSTNRRCFCCSILCSTIHHSRIGSLDSFSVTTAESSADVKMNECNSWCEDECKPWRQLRPFSFRLC

SEQ ID NO: 1034198 - protein, 516 aa, Homo sapiens
MASDPIFTLAPPLHCHYGALPPNASGWEQPPNSSGVSVAGAALAASAASRVVTSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGIMTLRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQELENTCPLPTTSTFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNDAAITTFSVLGLFSSQASAILSTLLAAEVIPTTVRGRGLGLIMALGALGGLSCPAQRLHMGHGAFLQHVVLAACALLCILSIMLLPETKRKLLPEVLRDGELCRRPSLLRQPPPNRCDHVPLLATS

SEQ ID NO: 1034199 - protein, 180 aa, Homo sapiens
MAGAGPKRRALAAPVAEEKEEAREKIMAAKRADGAAPAGEGEGVTLQGNITLLKGVAVIVVAIMGSGIFVTPTGVLKEAGSPGLALVVWAACGVFSIVGALCYAELGTTISKSGGDYAYMLDVYGSLPAFLKLWIELLIIRPSSQYIVALVFATYLLKPLFPTCPVPEEAAKLVACHSVH

SEQ ID NO: 1034200 - protein, 537 aa, Homo sapiens
MERDSHGNASPARTPSAGASPAQASPAGTPPGRASPAQASPAQASPAGTPPGRASPAQASPAGTPPGRASPGRASPAQASPAQASPAQASPARASPALASLSRSSSGRSSSARSASVTTSPTRVYLVRATPVGAVPIRSSPARSAPATRATRESPVQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESEVRFRKS

SEQ ID NO: 1034201 - protein, 102 aa, Homo sapiens
METVMTLEGGQKPVMESYTLLLSPPETQDEGWTLALSLALTYRLGPGSVLLAPRSPWRLQKPPPAGGLPHSQLPARQWGLLRQAGPKTVSPLGTYSPPTVTS

SEQ ID NO: 1034202 - protein, 219 aa, Homo sapiens
MTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSHSTPSFTSSTIYSTVSTSTTAISSASPTSGTMVTSHNHDPIFSEYRHPFHKQERDKITFCGLCRFPDYSDRPQI

SEQ ID NO: 1034203 - protein, 562 aa, Homo sapiens
MTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSHSTPSFTSSTIYSTVSTSTTAISSASPTSGTMVTSTTMTPSSLSTDTPFTTPTTITYPSVGSTGFLTTATDLTSTFTVSSSSAMSTSDIPSSPSIQNTETSSLVSMTSATIPSVRPTITSTDSTLTSSLLTTFPSTYSFSSSMSASSAGTTHTETISSLPASTNTIHTTAESALAPTTTTSFTTSPTMEPPSTTVATTSTGQTTFPSSTATFLETTTLTPTTDFSEETLTTAMTSTPPITSSITPTNTVTSMRTMTSWPTATNTLSSLTSSILSSTPVPSTEVTTSHTTNINPVSTLVTTLPITITRSTPTSETTYPSSSTSTVTESTTEITYSTTMTETSSSATSLPPTSSLVSTTETAKTPTTNLVTTTTKTTSHSTTSFTSSTVYSTASTHTTAITSVPTTLGTMVTSTSRIPS

SEQ ID NO: 1034204 - protein, 1728 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKAEGAQNQGKKAEGAQNQGKKAEGAQNQGKKAEEAQKQGKKAEGAQIQGKKDEGAQNQGKKAEGAQNQGKKVEGAQNQGKKAEGAQNQGKKDEGAQTQGKKAEGAQTQGKKAEGAQNQGKKAEGAQNQDKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTLHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSVCVSSLEKEVTVQLTKMPYTFLTNKPTNLHSVIQAQLPGTPREAMRDKSLRATEVDLPEPQFVNEPVSHLINTILGAAPGHRRVTPKPWLTLTAPWVCGRPGALGSVCQCNRLVFFQWGGAGSGWDRAASSQRLWGRLEATAPHPRRCQPELTCDLLGVDAIKTNVGAR

SEQ ID NO: 1034205 - protein, 1695 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKAEGAQNQGKKAEGAQNQGKKAEGAQNQGKKAEEAQKQGKKAEGAQIQGKKDEGAQTQGKKAEGAQNQGKKDEGAQTQGKKAEGAQTQGKKAEGAQNQGKKAEGAQNQDKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAEEEEQVWRAKVGAAEEELQKSRVTVKHLEEIVEKLKGELESSDQVREHTLHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSVCVSSLEKEVTVQLTKMPYTFLTNKPTNLHSVIQAQLPGTPREAMRDKSLRATEVDLPEPQFVNEPVSHLINTILGAAPGHRRVTPKPWLTLTAPWVCGRPGALGSVCQCNRLVFFQWGGAGSGWDRAASSQRLWGRLEATAPHPRRCQPELTCDLLGVDAIKTNVGAR

SEQ ID NO: 1034206 - protein, 343 aa, Homo sapiens
MDPEHCAPFRVGPAPGPYVASGDEPPGPQGTPAAAPHLHPAPPRGPRLTRFPACGPLEPYLPEPAKPPAKYLQDLGPGPALNGGHFYEGPAEAEEKTSKAASFPQLPLDCRGGPRDGPSNLQGSPGPCLASLHLPLSPGLPDSMELAKNKSKKRRNRTTFSTFQLEELEKVFQKTHYPDVYAREQLALRTDLTEARVQVWFQNRRAKWRKRERYGKIQEGRNPFTAAYDISVLPRTDSHPQLQNSLWAGPGSGSPGGPCLVSPEGIPSPCMSPYSHPHGSVAGFMGVPAPSAAHPGIYSIHGFPPTLGGHSFEPSSDGDYKSPSLVSLRVKPKEPPGLLNWTT

SEQ ID NO: 1034207 - protein, 309 aa, Homo sapiens
EGRRMDLSGVKKKSLLGVKENNKKSSTRAPSPTKRKDRSDEKSKDRSKDKGATKESSEKDRGRDKTRKRGSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 1034208 - protein, 305 aa, Homo sapiens
MDLSGVKKKSLLGVKENNKKSSTRAPSPTKRKDRSDEKSKDRSKDKGATKESSEKDRGRDKTRKRGSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 1034209 - protein, 88 aa, Homo sapiens
IRHEATVVISKLRAIPSLLSTAPRLLHGSFLHNVAVAARFLRQPRWEAADHGDSALHGRQRPRDTDVHELAAFQGVLRVAMGDTSHSF

SEQ ID NO: 1034210 - protein, 88 aa, Homo sapiens; identical to SEQ ID NO: 1034209

SEQ ID NO: 1034211 - protein, 88 aa, Homo sapiens; identical to SEQ ID NO: 1034209

SEQ ID NO: 1034212 - protein, 30 aa, Homo sapiens
TFVLLGNSLYLGDTQDKLIFGKGTRVTVEP

SEQ ID NO: 1034213 - protein, 1699 aa, Homo sapiens
AAAAAVNGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVEKDTTELMEKLEVTKREKLELSQRLSDLSEQLKPKPGEISFLNEEVKSLKPEKEPVSLRCRELEIIINHNRAENVSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMPQMERQREDQELATRRD

SEQ ID NO: 1034214 - protein, 1639 aa, Homo sapiens
MEDEERQKKLEAGKAKIEELSLAFLVRQLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVEKDTTELMEKLEVTKREKLELSQRLSDLSEQLKPKPGEISFLNEEVKSLKPEKEPVSLRCRELEIIINHNRAENVSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMPQMERQREDQELATRRD

SEQ ID NO: 1034215 - protein, 252 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 1034216 - protein, 252 aa, Homo sapiens; identical to SEQ ID NO: 1034215

SEQ ID NO: 1034217 - protein, 252 aa, Homo sapiens; identical to SEQ ID NO: 1034215

SEQ ID NO: 1034218 - protein, 127 aa, Homo sapiens [sequence omitted]

SEQ ID NO: 1034219 - protein, 39 aa, Homo sapiens
VDTAVYYCARKNKYCTNGVCYRHFDYWGQGTLVTVSSGS

SEQ ID NO: 1034220 - protein, 32 aa, Homo sapiens
DSITMVRGIIILGGGHFDYWGQGTLVTVSSGS

SEQ ID NO: 1034221 - protein, 33 aa, Homo sapiens
VDTAVYYCARALTGYQYFDYWGQGTLVTVSSGS

SEQ ID NO: 1034222 - protein, 447 aa, Homo sapiens
MEEMLSFWDVAIDFSPEEKECLDPAQWDLYRDVMLENFSHLDFLGLAVAKPYLVTFLEQNQGSSGVKSQTSATIPPGTTGNEFNNHNEAIDHSSLSMQCQRIHTGEEPYYFEDCGKALSSQATLSVLQGHFIGDKPYKCRECHKTLSSRSSLLIHQKYHTDEKTYKCEKCGKGFFRSSDLQHHQKIHTGEKPYKCEECDKAFLHHSYLRKHQAVHTGEKPYKCEECGNSFYYPAMLKQHQRIHSGEKLDKCEECGKVFSSAFFLNQHKGIDSGEKRYKCQECGKSFCYRSYLREHYRMHSGEYPYKCEECGKGFSRSSKLQEHQTIHTGVKPYKCEECGKCFSSFTSLKRHQIIHSEDTPHECVECGKRFSSSSRLQEHQKIHTEEKPYKCEECDKAFLYHSFLRRHKAVHTREKPYMCEKCRKCFSSFTSLKRHQIHSIDISHECV

SEQ ID NO: 1034223 - protein, 158 aa, Homo sapiens
MPALLPVASRLLVATPSLADHGLWKPFQTQPYAGLRIPGSGYVPGSVSAAFVTLPQREGRQGDRQAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 1034224 - protein, 186 aa, Homo sapiens
LLLLSHGARCFLITWSVTQASLLLSFVWMPALLPVASRLLVATPSLADHGLWKPFQTQPYAGLRIPGSGYVPGSVSAAFVTLPQREGRQGDRQAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 1034225 - protein, 85 aa, Homo sapiens [sequence omitted]

SEQ ID NO: 1034226 - protein, 34 aa, Homo sapiens
EKTTEGQEKEESKKDRKEGKEKDKDKEKSDVKKE

SEQ ID NO: 1034227 - protein, 249 aa, Homo sapiens
MQILDGITDALHDLGCFSFCECLVSSILNSAKEFSTVQTFHDNQHALHPCVQILVHIHDQYDVRALGGPPVQLHLPAGLGAVLKHFEGEFLLGPLVEDLQNFAVDAQPQDLAGDLVVIDDGVLLDLQAGLDVELRELLRGRRRRLRRGVRQGRGRGLRRRGRGGERHRRALALGVGQHGARGRRGTGGGARGRPLLRLRAPSPPPPDGLRSSLRAGAGFPDPARLQARRVAGLRGSHRAPLAPTGPAPP

SEQ ID NO: 1034228 - protein, 164 aa, Homo sapiens
DHRHRERRDLDQARRRECALRPVGETPHFRAQEPHPPHEADIARRALEIQPDADRDGQHRERERQHLALVDGISAAVNVHSPACPAQCFGSANQRRLRDGARSAVIVLIDPLSTRRRTRIRERHRHACRGRRAAPAQHVARDPHVLLGERLGGQVAVAQARGGR

SEQ ID NO: 1034229 - protein, 108 aa, Homo sapiens
KYMTISGFQIETIDRETFGNLANSSLLVGNLFEVLPAYLAETLYYAMKGLEQIDHTLIRVMVPRSEIDLFNIRKEFRKNFATSLYSMIKGDTSGDYKKALLLLCGEDD

SEQ ID NO: 1034230 - protein, 108 aa, Homo sapiens; identical to SEQ ID NO: 1034229

SEQ ID NO: 1034231 - protein, 313 aa, Homo sapiens
PGPPLRWCWFLIRLVLSGALPLAGAGSSSVSWSPGPSPSLVLVRHPSRALRGLHWCWHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMEVRLAWASVLTLHAPHEAGNQRSQVQPACTICLPLTWRGWNEASMGLPILNHLSLASGPQGETGILEPIPFPLPGFPNRTASGQSGFCGVPPPRPLALFHPEGPGKRAPPTLTDLPPGPRGPAKL

SEQ ID NO: 1034232 - protein, 419 aa, Homo sapiens
VLVSRLSKHHQLLFGTGLLKAEPTRRYRVWSRILQAVNALGYCRRDVVDLKHKWRDLRAVVRRKLGDLRKAAMAPALVSGKPQALALTPVEQVVAKTFSCQALPSEGFSLEPPEATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMEVRLAWASVLTLHAPHEAGNQRSQVQPACTICLPLTWRGWNEASMGLPILNHLSLASGPQGETGILEPIPFPLPGFPNRTASGQSGFCGVPPPRPLALFHPEGPGKRAPPTLTDLPPGPRGPAK

SEQ ID NO: 1034233 - protein, 290 aa, Homo sapiens
AAAAWTLPASCPPSPLLGAPGPLHPHLGPDAGGLMTLGTDVCGLSQVTGAWEAQIDAQDRLVAAEGPRLRPRSSPQRADGDSEGKSTILLNFWAWVVVVMGGVSANKICCHQQSPQAPFAELADDEKVFNGSDNMWQGQEQALLPDITEEDLEAIRLREEAILQMEVRLAWASVLTLHAPHEAGNQRSQVQPACTICLPLTWRGWNEASMGLPILNHLSLASGPQGETGILEPIPFPLPGFPNRTASGQSGFCGVPPPRPLALFHPEGPGKRAPPTLTDLPPGPRGPAKL

SEQ ID NO: 1034234 - protein, 113 aa, Homo sapiens
KKKNTAPPTPGAPPSRPSPAPPRARRSLPPHPAPSLSLSPPLPVLPPPRGSAAWGRRRGEKGRGGRGRRRPGGGGTVPREGGPGTRGAGGGGDSGREPGPSRGSPQLRRASRP

SEQ ID NO: 1034235 - protein, 72 aa, Homo sapiens
MTVIPPPRGSAAWGRRRGEKGRGGRGRRRPGGGGTVPREGGPGTRGAGGGGDSGREPGPSRGSPQLRRASRP

SEQ ID NO: 1034236 - protein, 112 aa, Homo sapiens
VYTVVDKMFLAGEIRKTSQTKVLKQLLMLQSLEWRAGEPPPGPGPFWNCLLAFPFQGRGQPNSPFLSCLGGRDPAGFGPQGRRLPPPAFGPWLWAKAPVCVPSNRAVVVLFH

SEQ ID NO: 1034237 - protein, 134 aa, Homo sapiens
PSRVAGVLGFAAIHNLYSMFDCDKKILPVLCGLTVDPEKSVRDQAFKAIRSFLSKLESVSEDPTQVEEVEKNVHAASSPGMGGTAARWAGWAVIGVSSLTSNLIRLVPTFAPPFIHSPWEMFTSMNKLPPLVKK

SEQ ID NO: 1034238 - protein, 134 aa, Homo sapiens
ATPIPHSLTLLIPSDAFVESGQISFIYLWPMPFPLFILIPFFFEETPVTKKQPPEAKTMPGTPIASPLLSRKKFPEKKKFFGLLGGQKTTKTSGGETGNVFGPKTAFKTKKKGAFGGSSLPFYILKEEINLAKK

SEQ ID NO: 1034239 - protein, 113 aa, Homo sapiens
MGKMGPSCNMKVHDEQLVISYSACHLVMFNAAKGAKVMNKTEKFLPSLMFILANGEDDKNCTSLSKRDTMDNGKIYGKAGCLPCLRRTYWTILLCTSRCVHEYIHKTMACGIL

SEQ ID NO: 1034240 - protein, 124 aa, Homo sapiens
QRSRWTPVIKDDMKTPVEDRLDRNLWPFVSDPGPQGQFPGRCQCPFWVIGPKNKAGVKARGGPRLFVYVMGGVAMSEMRAAYKVTRAPEGKWKVLIGSSHILTPTRFLDDLKALDKKLEDIALP

SEQ ID NO: 1034241 - protein, 152 aa, Homo sapiens
PRVSEFASFRRRKGMTGWARGGHCLRAHSRPSLAPRSLRARPGSRSRFFGSAFRAHPYATTADWAPPLSLSRRRRGDDGAGELDGRGRRPGCDARHRRARRLAPALSALAPLDDPPPRAVGGSRQWSVPDASSRRESRELADAKSLFLASTY

SEQ ID NO: 1034242 - protein, 123 aa, Homo sapiens
MRGLPYKATENDSYNFFSPLNPVRVHIEIGPDGRVTGEADVEFATHEEAVAALSKDRANMQHRYIELFLNSTTGASNGAYSSQVMQGMGVSAGPSTYSALESQSVSGCYGAGYSGQHSMGGYD

SEQ ID NO: 1034243 - protein, 71 aa, Homo sapiens
SIIRRGRPSPRGPGHLPWTNLCAEPNSRVAWEQSFPKIPRREMSVPWNKEVGAVWPPPPLGVDTCFLGWVG

SEQ ID NO: 1034244 - protein, 68 aa, Homo sapiens
LSGSAACVRFTVNDSQHTEALVNILESGQKPYSRQSDSATAGMPCGTEGSMPLDRGFLSVSHVFVQFS

SEQ ID NO: 1034245 - protein, 120 aa, Homo sapiens
DAHDATVQKALKREMERLLETHLHWITNSNLYLIERPRIRLDEMNRGSNEWKTVVGGAMFFIGFTALVIMWQKHYVYGPLPQSFDKEWVAKQTKRMLDMKVNPIQGLASKWDFEKNEWKK

SEQ ID NO: 1034246 - protein, 135 aa, Homo sapiens
FAPLYDRGDTPVPEVAHVKHLSASQKALKEKEKASWSSLSMDEKVELFALSSRRSFSEMNRGSNEWKTVVGGAMFFIGFTALVIMWQKHYVYGPLPQSFDKEWVAKQTKRMLDMKVNPIQGLASKWDFEKNEWKK

SEQ ID NO: 1034247 - protein, 154 aa, Homo sapiens
MKPHERDAVIELTQILKAQNDKESIQVRCLCTEATRPPPVLARTHDLLLSLKRTMCKEGLDIEQNHFKWTGNYVSGLNTSAHLKTVVEVDKANIKKAAMDLGLRKYEILTPVEEAPKGMLRGGTYHNKSFFTEDDKQDHLSWEWNLSIKKEWTE

SEQ ID NO: 1034248 - protein, 222 aa, Homo sapiens
LETTAKVLKQRVDSLTAKLQGAEAPDTVRDPAVGLLRSCPHSLPAAPTLATPTLATPACPGALGPNWGRGAPGEWVSMQPQPLLPPTYFLEGETLSWGPSWEQQQSVSPRAHCESKPRGFPEEGHVDVKPDKRLQRGVAPFQALSPSAGSSYAGPATLHPIWGSLGLEETPSVEGQILWRPAPPGAAVRATLRTGPGLAGRVAGASTENTFHCLALELGPTG

SEQ ID NO: 1034249 - protein, 137 aa, Homo sapiens
EVCLRLLSCCDGLGPPSRAPGCPGSEARCPLLQGFPEEGHVDVKPDKRLQRGVAPFQALSPSAGSSYAGPATLHPIWGSLGLEETPSVEGQILWRPAPPGAAVRATLRTGPGLAGRVAGASTENTFHCLALELGPTG

SEQ ID NO: 1034250 - protein, 172 aa, Homo sapiens
AWSLRRPGPGPAHSGGVQTRENWIAYPLQSAEDGVATRLQIREESASCLAAEYWSQEPAMRFLRTECCFRAGSSISAQEKVIFPEDVSPKDQPPSVWIPKTHHQRVKHAPMYTCPDPEIFGSKRPIGYPSPPPPLGFFLSRIAAGVWWNPSHPQSPPQPPPPVAGTTAHTPA

SEQ ID NO: 1034251 - protein, 205 aa, Homo sapiens
LDQFFLSQNPKASSQPFHGCTDTYPWDRLYLSSLRCQIFPLQTGWKREPAQRHFFSKHDTRTSFDKEGPYCLLQGIGRRKDLERLWQRHTFLRWAPCEIELRQQGPLESSYQADFRPGPGLSGLPQHLIHFVQVQPSHTRTTYQQNFCCPSQGGHYGSYKVGPQAPVTDVLPDLPGIPRPKLLQHYLHAGVSECLNWSRALNKDS

SEQ ID NO: 1034252 - protein, 317 aa, Homo sapiens
VWLKGAGAPGPPGDAVAAAAASVASTRARRGERNEHTCEYWMPVSLPLPALQRHRAVASEKQLLPLHLGLALPAHVSTMETLSQDSLLECQICFNYYSPRRRPKWLDYKHTCCSVCLQQMRTSQKDVRCPWCRGVTKLPPGFSVSQLPDDPEVLAVIAIPHTSEHTRVFIKLPSKGCYMLPLPISKERALLPGDMGCRLLPGSQQKSVTVVTIPAEQQPLQGGAPQEAVEEEQDRRGVVKSSTGSGVCTVILGACVLDSLLGIVLHNMSCISKRFTVIILWLKRAAGKSLVGANLGVEQVDDEIPVRRWGATLTIWC

SEQ ID NO: 1034253 - protein, 72 aa, Homo sapiens
LLVECKVAQTTVENSLAIQKFKQYYYPRIQCSTSGCTPEEVKAGTPKDCTSLSTQHCPQQQKVETTHVSLDE

SEQ ID NO: 1034254 - protein, 25 aa, Homo sapiens
MGEDFSHSCEQLSASYVARDHKTTM

SEQ ID NO: 1034255 - protein, 474 aa, Homo sapiens
WCPSSTRYHVPHYLFSFSHGHYVDCVFSDELLDYHRDMHSVVYSLGAPPFVSSYRDLFLWSRCSYGRTTVLLKPLLLSASSSQFVVVLWSLLASPSSASLFSQAKVTSNVCRVSSQGVLRSESASSGFSVAHRTVDQDPRSLPGSHCVVLSEGDGRRAVFFSERDCYSRGWDKSLGAVPGGHGAAIPNPALETCASAELCCSPALMWSSCTLPLLAAPVCVLMSCCVMLLSAVAALCAVVLAAAMMPCCMCVGDPCDLCCTDLPCCCAPLCDLLLCPVWCCAPAAVLPCLDLYICAVADAGCCCTDVPLWTCCACLGCVSVPSVPSGADCASFSACSVLLLCWWMWRRDCCVVLCYNPLQPLAPINLTLRSLSQPNDDPWALGSVACWGMWYTLGLVAPRCGLNHPSGSRLPFGGLLLDDMWMCLLWAVLCVLPVVGNPPGWAFFFGTLWWFEPWRWRLFVLARTCALFGSEVL

SEQ ID NO: 1034256 - protein, 111 aa, Homo sapiens
GVHPFLGSFQGPTQPAPRPPWRRNDSKITGPVNLLEWEPGVLEGGTCSGTHCWPWGAENSGLCDSEVQVLPPATAVSRIGPTPGGSACSGYNKTKGLRCTSTVELSSWLLL

SEQ ID NO: 1034257 - protein, 132 aa, Homo sapiens
GVHPFLGSFQGPTQPAPRPPWRRNDSKITGPVNLLEWEPGVLEGGTCSGTHCWPWGAENSGLCDSEVQVLPPATAVSRIGPTPGGSARCNARSSISHAVNKGETPSALQRTSALPSLGWGNNASHGWSPGSQ

SEQ ID NO: 1034258 - protein, 261 aa, Homo sapiens
PSSPATEEPANLSRRLCWGLSVPASRMEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPADPMLGLALGGLVVSAVSLAGCLGALCENTCLLRGFSGGILAFLVLEAVAGALVVALWGPLQDSLEHTLRVAIAHYQDDPDLRFLLDQVQLGLRCCGAASYQDWQQNLYCLSSLALPQ

SEQ ID NO: 1034259 - protein, 355 aa, Homo sapiens
MEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPTDPMLGLALGGLVVSAASLAGCLGALCENTCLLRGFSGGILAFLVLEAVAGALVVALWGPLQDSLEHTLRVAIAHYQDDPDLRFLLDQVQLGLRCCGAASYQDWQQNLYFNCSSPGVQACSLPASCCIDPREDGASVNDQCGFGVLRLDADAAQRVVYLEGCGPPLRRWLRANLAASGGYAIAVVLLQGAELLLAARLLGALAARSGAAYGPGAHGEDRAGPQSPSPGAPPAAKPARG

SEQ ID NO: 1034260 - protein, 95 aa, Homo sapiens
MTAKSQVCLEASGRISILPLWSILWAVGTRALLLKAKVANSLSLFSSEVAKQECPMWCSDSVQAFMLGSVNVTLNSYEPIESPIPSFSSASPGHV

SEQ ID NO: 1034261 - protein, 141 aa, Homo sapiens
MTGPFPSERDQVRPDSQMRIQDTDNYTCLSRTVCWVLTNIKLLIQEPLEIFVIYCESRDITFHISDTEKEQICQRCFTVSCYLFKKTVLENYGKTHLEEGCAFSHQSMKYNLTFKLKCCSSKLIFPVLIPSFLVQGRRGKG

SEQ ID NO: 1034262 - protein, 165 aa, Homo sapiens
MTGPFPSERDQVRPDSQMRIQDTDNYTCLSRTVCWVLTNIKLLIQEPLEVNLFLSIPYCCPCYSLGVPVSCYYIFVIYCESRDITFHISDTEKEQICQRCFTVSCYLFKKTVLENYGKTHLEEGCAFSHQSMKYNLTFKLKCCSSKLIFPVLIPSFLVQGRRGKG

SEQ ID NO: 1034263 - protein, 101 aa, Homo sapiens
MLLFNCSYLSPQNPFPPAQRSEQDAALFSEQLLSPRPGRSWRRQSPKFEGAAKLGGGGRCWRLGPCPPPPPSSRPAPAAPRPPRIPLTYHVRGEGGGGGGR

SEQ ID NO: 1034264 - protein, 190 aa, Homo sapiens
MKTKFCTGGEAEPSPLGLLPLPLPQPPPPQPPADEQPEPRTRRRAYLWCKEFLPGAWRGLREDEFHISVIRGGLSNMLFQCSLLTPQPPLVMSLGKVLLRAVWKRIRTRRSCNTSREQKKATEDPRHPRRLKDHRYMEARKRRPYDDEQAPHAPHNHNANHHPGHTDHRYTRRRPKQPPKSHDKTRTPTK

SEQ ID NO: 1034265 - protein, 236 aa, Homo sapiens
MKTKFCTGGEAEPSPLGLLLSCGSGSAAPAPGVGQQRDAASDLESKQLGGQQPPLALPPPPPLPLPLPLPQPPPPQPPADEQPEPRTRRRAYLWCKEFLPGAWRGLREDEFHISVIRGGLSNMLFQCSLLTPQPPLVMSLGKVLLRAVWKRIRTRRSCNTSREQKKATEDPRHPRRLKDHRYMEARKRRPYDDEQAPHAPHNHNANHHPGHTDHRYTRRRPKQPPKSHDKTRTPTK

SEQ ID NO: 1034266 - protein, 77 aa, Homo sapiens
NGNGKPRRNESHRKEARKTQAGRGLGVVLKPRHVFSMWSLMPERPFALTFTQLFLLLKNLKYLKMSSLYERTLPRVL

SEQ ID NO: 1034267 - protein, 118 aa, Homo sapiens
AVCIFLMFDGPDIRGSSKVIFPGKSDQTVRTKRLLANFVETTEELSPQQRSWKERDIGNFTVIVHAVILFICKNCGWFTLTLEQELPMKEDGWSQMPGHSFWSSRELSVPADSSVKWG

SEQ ID NO: 1034268 - protein, 77 aa, Homo sapiens
PSQCTLLASAVRSADQNVSMVFHGLVAQCGRWLDLPAQPVNARMEESVVLWILSVFKIIEVFTVDSTQKNGRNDHPT

SEQ ID NO: 1034269 - protein, 234 aa, Homo sapiens
RGTGGPQQRAAHRDHSHARRHEECALRTHTWWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGPVWTMAGSPCTTCKCKNGRVCCSVDFECLQNN

SEQ ID NO: 1034270 - protein, 105 aa, Homo sapiens
STGEMKMPALLDPGGMECGVWAQWLVQAWAGQTCPGVSGHCGRRTRGQQVPPGEERRARLSCISGLQGELGEVTETLPHPQPVSICGSLGKLPHLSEPRMRSFQD

SEQ ID NO: 1034271 - protein, 124 aa, Homo sapiens
TGDNKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 1034272 - protein, 162 aa, Homo sapiens
TGDNKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQVHYCDRQSGKECVTCLTLAPVQMTFHAIGSSIEASHDQV

SEQ ID NO: 1034273 - protein, 124 aa, Homo sapiens; identical to SEQ ID NO: 1034271

SEQ ID NO: 1034274 - protein, 124 aa, Homo sapiens; identical to SEQ ID NO: 1034271

SEQ ID NO: 1034275 - protein, 158 aa, Homo sapiens
MVIDGLERAKETPGLNPGLPHGSAAEFFLEAVWCVTQQGPCVGQQEGGVGGLSRRGTMRAFHEPSQALLHHGRPGPPSRPGDAQGAGRGSGGRTQGSEAGTGAGEPGQGRGAPIKAGRAAAGGPGGYKLLCALHKPESPTREDVCEEPETLNPIKREK

SEQ ID NO: 1034276 - protein, 128 aa, Homo sapiens
MKHTHPQKQRGVGGPAVDRSLSGQARGVGAGEDSDDVHRPKAVTSISLKCLKVGMGRRLGPAGPHHGHARQSASSPALQRWPRRLPRRMTRLQKSDVLPSLAQSLLRAAGPKAEANALPPQKTLELVS

SEQ ID NO: 1034277 - protein, 99 aa, Homo sapiens
SPPWPETFRRKQKDEKASLARPISPPTPQSYTFINSQACSQAWAYVAGERLLPYEMVEDRKLLNETSVTRLPLPNPGDPFKRRGLCSALGQKGSACQPQ

SEQ ID NO: 1034278 - protein, 125 aa, Homo sapiens
VGCGVTWFYPLRLRNISTKPDALSSYLQTSRPLAKNPLKFWDNVRWYPDLFNDYSVKVLIGLSSIFLSWWTRFRGKARNSMILFKTCQNRRERENISYPCDQQCEENRGYADFRRDLQSFMFIGI

SEQ ID NO: 1034279 - protein, 190 aa, Homo sapiens
MAFVKSGWLLRQSTIFEALEEELVVILWSDGHLIYYDDQTRQNIEDKVHMPMDCINILQGQECRDTQPPDGNVTNDCMLQIVCRDGENNESLGRKRTSSDVLWSGKFYHFQNPRTNTAYVGSAVMPDETSVVSSPPPYTAYAVHRPLRVGRTLSLQQAYGYWAITVVRTRQELKLSTLLNGQAYAVPNST

SEQ ID NO: 1034280 - protein, 145 aa, Homo sapiens
RSGGMSGRRGRGVRGEPGHAGHVSIILPVHNAEPWLDECLRSVLQQDFEGTMELSVFNDASKDKSGAIIEKWRVKLEDSGVHVIIGGHDSPSPRGVGYAKNQAVAQSSGSYLCFLDSDDVMMPQRWRLQHEAAVSAPVEHHWFAE

SEQ ID NO: 1034281 - protein, 137 aa, Homo sapiens
MTFPTARGHKSMIQHYRNPPTSRKVSTTHKDSHVHADTKTHFREEAPRHSLKPQLGPFLHDNSSASLGQCNPWSNPSFALTGDNPPLPHPPGEEMAVFVIFPDVLMGARHQRVPRKVHISWGNFDQTVKRKRLFGLT

SEQ ID NO: 1034282 - protein, 70 aa, Homo sapiens
GPVSDVGTHDGALRGRTRGRWGTWGRRGTWRAPEGRGGAEGRGGGAEWDARQWPLRDVGVLRHRHRKHQL

SEQ ID NO: 1034283 - protein, 70 aa, Homo sapiens; identical to SEQ ID NO: 1034282

SEQ ID NO: 1034284 - protein, 99 aa, Homo sapiens
PLPKLTDPRLLYICFLGYCRGLIDYLIARRPIAPAGLHRQLLYITAFFVAGYYLVKREDYLYAVRDREMFGYMKLHPEDFPEEDKKTYGEIFEKFHPIR

SEQ ID NO: 1034285 - protein, 150 aa, Homo sapiens
RLHRELSRVPACLSPGAGGRRGKQAAVRRGRWPNSRLGVRWLRSELAGATTRTASPFPSLRARARRVAEAVGGAEPARRDLRRRSGSECGSPSCPPADKADNMATSAPPLKQVPRKLSPAGAWAAAESRARLGGRRPSTSSFPPQSSPRP

SEQ ID NO: 1034286 - protein, 201 aa, Homo sapiens
MPALALYLLLRMPIMSSPPTTRARSSKLRHRVYGGKGLEAASCRNLGMTKASGAAPWTAAGQGAWRSPPQTWRLVTLGSESARSGPAVLPPTASATLGPCLCCSWWLRVRFVSASRTVIFFVLFLFGATSVSHDGPSAYVTRRPSGVPPETPPLLRASSRPREGPCGPAHSPWPHPLLVSVLHLPSGVPQLEKNQMQVLSG

SEQ ID NO: 1034287 - protein, 98 aa, Homo sapiens
SGRERGASPALNVSTAVHRQALRQRAMFLLLVLLTGLGGMHADLNPHKIFLQTTIPEKISSSDAKTDPEHNVIYMITIGKAIFCPSQKAINFIFSFCY

SEQ ID NO: 1034288 - protein, 394 aa, Homo sapiens
MDCNYNGYVAGIPNSLVTLSVCSGLRGTMQLKNISYGIEPMEAVSGFIHKIYEEKYADTNILLEENDTYTWFNSEYQVRKSSEYSGGVKDFNICSLDDFKYISSHNGLTCLQTNPLEMPTYTHRRICGNGLLEGSEECDCGTKDFKPANMICRKSVGKECDFTEYCNGDLPYCLPDTYVRDGEYCDSGGAFCFQGKCRTFDKQCDDLIGRGSRGAPVFCYDEINTRGDNFGNCGTAHCLFQHILCGKLVCTWEHRDLISRPNLSVIYAHVRDQTCVSTYLPRRTPPPVNSPISITSYYSAEDRDETFVQDGSMCGPDMYCFEMHCKHVRFLMNLKLCDASNHCDRHGVCNNFNHCHCEKGYNPPYCQPKQGAFGSIDDGRLVPPTERSYMEEGR

SEQ ID NO: 1034289 - protein, 333 aa, Homo sapiens
MDCNYNGYVAGIPNSLVTLSVCSGLRGTMQLKNISYGIEPMEAVSGFIHKIYEEKYADTNILLEENDTYTWFNSEYQVRKSSEFKPANMICRKSVGKECDFTEYCNGDLPYCLPDTYVRDGEYCDSGGAFCFQGKCRTFDKQCDDLIGRGSRGAPVFCYDEINTRGDNFGNCGTAHCLFQHILCGKLVCTWEHRDLISRPNLSVIYAHVRDQTCVSTYLPRRTPPPVNSPISITSYYSAEDRDETFVQDGSMCGPDMYCFEMHCKHVRFLMNLKLCDASNHCDRHGVCNNFNHCHCEKGYNPPYCQPKQGAFGSIDDGRLVPPTERSYMEEGR

SEQ ID NO: 1034290 - protein, 383 aa, Homo sapiens
MQTSILIKSSCRPQFQRRFHHRMQKQIQNIISILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEKTDFIKLFPRYIEMHIVVDKNLVKPANMICRKSVGKECDFTEYCNGDLPYCLPDTYVRDGEYCDSGGAFCFQGKCRTFDKQCDDLIGRGSRGAPVFCYDEINTRGDNFGNCGTAHCLFQHILCGKLVCTWEHRDLISRPNLSVIYAHVRDQTCVSTYLPRRTPPPVNSPISITSYYSAEDRDETFVQDGSMCGPDMVCNNFNHCHCEKGYNPPYCQPKQGAFGSIDDGRLVPPTERSYMEEGR

SEQ ID NO: 1034291 - protein, 183 aa, Homo sapiens
SGRELGLSSSQRLNCCSSPGSKTASHVPSSGASHWTWWDACRPQSILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEKTDFIKLFPRYIEMHIVVDKNLVLWWCKGF

SEQ ID NO: 1034292 - protein, 192 aa, Homo sapiens
MQTSILIKSSCRPQFQRRFHHRMQKQIQNIISILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEKTDFIKLFPRYIEMHIVVDKNLGVSAAIVKFQEGGMLSGLSRQWPKNNKKPY

SEQ ID NO: 1034293 - protein, 170 aa, Homo sapiens
MQTSILIKSSCRPQFQRRFHHRMQKQIQNIISILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEKTDFIKLFPRYIEMHIVVDKNLVLWWCKGF

SEQ ID NO: 1034294 - protein, 98 aa, Homo sapiens; identical to SEQ ID NO: 1034287

SEQ ID NO: 1034295 - protein, 355 aa, Homo sapiens
MDCNYNGYVAGIPNSLVTLSVCSGLRGTMQLKNISYGIEPMEAVSGFIHKIYEEKYADTNILLEENDTYTWFNSEYQVRKSSEKTDFIKLFPRYIEMHIVVDKNLVKPANMICRKSVGKECDFTEYCNGDLPYCLPDTYVRDGEYCDSGGAFCFQGKCRTFDKQCDDLIGRGSRGAPVFCYDEINTRGDNFGNCGTAHCLFQHILCGKLVCTWEHRDLISRPNLSVIYAHVRDQTCVSTYLPRRTPPPVNSPISITSYYSAEDRDETFVQDGSMCGPDMYCFEMHCKHVRFLMNLKLCDASNHCDRHGVCNNFNHCHCEKGYNPPYCQPKQGAFGSIDDGRLVPPTERSYMEEGR

SEQ ID NO: 1034296 - protein, 488 aa, Homo sapiens
MQTSILIKSSCRPQFQRRFHHRMQKQIQNIISILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEKTDFIKLFPRYIEMHIVVDKNLAEVSESVAPDWSASGMILGSPKPLPFWVQAIHLPSASQVAGTARYSGGVKDFNICSLDDFKYISSHNGLTCLQTNPLEMPTYTHRRICGNGLLEGSEECDCGTKDFKPANMICRKSVGKECDFTEYCNGDLPYCLPDTYVRDGEYCDSGGAFCFQGKCRTFDKQCDDLIGRGSRGAPVFCYDEINTRGDNFGNCGTAHCLFQHILCGKLVCTWEHRDLISRPNLSVIYAHVRDQTCVSTYLPRRTPPPVNSPISITSYYSAEDRDETFVQDGSMCGPDMVCNNFNHCHCEKGYNPPYCQPKQGAFGSIDDGRLVPPTERSYMEEGR

SEQ ID NO: 1034297 - protein, 422 aa, Homo sapiens
MQTSILIKSSCRPQFQRRFHHRMQKQIQNIISILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEYSGGVKDFNICSLDDFKYISSHNGLTCLQTNPLEMPTYTHRRICGNGLLEGSEECDCGTKDFKPANMICRKSVGKECDFTEYCNGDLPYCLPDTYVRDGEYCDSGGAFCFQGKCRTFDKQCDDLIGRGSRGAPVFCYDEINTRGDNFGNCGTAHCLFQHILCGKLVCTWEHRDLISRPNLSVIYAHVRDQTCVSTYLPRRTPPPVNSPISITSYYSAEDRDETFVQDGSMCGPDMVCNNFNHCHCEKGYNPPYCQPKQGAFGSIDDGRLVPPTERSYMEEGR

SEQ ID NO: 1034298 - protein, 145 aa, Homo sapiens
MQTSILIKSSCRPQFQRRFHHRMQKQIQNIISILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEECQQL

SEQ ID NO: 1034299 - protein, 98 aa, Homo sapiens; identical to SEQ ID NO: 1034287

SEQ ID NO: 1034300 - protein, 567 aa, Homo sapiens [sequence omitted]

SEQ ID NO: 1034301 - protein, 45 aa, Homo sapiens
GRLLLLLLLEFKLLTMYGDMGAVFKDTRAPSPPGAPLKMERGLRK

SEQ ID NO: 1034302 - protein, 106 aa, Homo sapiens
YVQQVARSGGSRARARWPLTGMTLRTCVSQQWKSSHPETRLWPFLHFSSRTVFPWALVTPGTGGRASPPLAGRWGATEGEAAARNLLEFGRRGRRRVYRRRRGVPG

SEQ ID NO: 1034303 - protein, 106 aa, Homo sapiens; identical to SEQ ID NO: 1034302

SEQ ID NO: 1034304 - protein, 106 aa, Homo sapiens; identical to SEQ ID NO: 1034302

SEQ ID NO: 1034305 - protein, 161 aa, Homo sapiens; identical to SEQ ID NO: 35

SEQ ID NO: 1034306 - protein, 97 aa, Homo sapiens; identical to SEQ ID NO: 36

SEQ ID NO: 1034307 - protein, 163 aa, Homo sapiens; identical to SEQ ID NO: 37

SEQ ID NO: 1034308 - protein, 96 aa, Homo sapiens; identical to SEQ ID NO: 38

SEQ ID NO: 1034309 - protein, 224 aa, Homo sapiens
RRRRCPRHRHCLERPHRGGGRRRRPRAATSPALGAVTVPRRPGLLQSTKTRGGRRGSERGRQRRRAGRQLQAEPRAPAGTGPFTRRGTQSCERILFSADSTPGRRLEVGLCLGLTRRETTELLPQPPAARNWKKKKKKKKKSSWGLGTRLLAPLNSPRLSPPSPPVMNPVKGDRPGSPRNIYSCDSHKMEKGLNFCFFKELVFCVCVYTASSHQPNCLAPLQLR

SEQ ID NO: 1034310 - protein, 207 aa, Homo sapiens
MIAECGMKVPSRQKAVTSVSGVVVLWGECMENFKASSWLPRKGRQRRRAGRQLQAEPRAPAGTGPFTRRGTQSCERILFSADSTPGRRLEVGLCLGLTRRETTELLPQPPAARNWKKKKKKKKKSSWGLGTRLLAPLNSPRLSPPSPPVMNPVKGDRPGSPRNIYSCDSHKMEKGLNFCFFKELVFCVCVYTASSHQPNCLAPLQLR

SEQ ID NO: 1034311 - protein, 707 aa, Homo sapiens
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYQPMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKENLRAGFHRPRSYRLPAAWGLVGTELRVGVQDPMSPAIRPGHRQMYWSSPRETQEEGKEVRYEPSRMEEEGGRYTRSAFADPAVKGCTVPGYELYLPRCSMKENGSVVEIQNLLGEKYIHGVQMRPGVACSVSQAQKDEFILEGNDIELVSNSAALIQQATTVKNKDIRKFLNVSSYFRKKPLVSEPRQQPVLPSKLPDPKREFQNRQSKSFLAEVPGLETLGFLSEEHPLVSVHGERRSVSPFAPPAPSASLPQTQTLPREASQRRGQKAATQSRHIPRLGRRHSPQTPWTPAVYEDARGTAWFREANMEEVVIGCCGLTGLSLRVPSTCDLVPGVPRSPVSSFASWGRGLKMLALPSSRLLGTSKEIRAVEGSLASEMELGEGAKGDVPAASSRPSPERLQEQAPSPGAGRRAARESCSARTQRQGAA

SEQ ID NO: 1034312 - DNA, 1302 bp, Homo sapiens; identical to SEQ ID NO: 7
